United States Patent
Rotem et al.

(10) Patent No.: US 11,859,197 B2
(45) Date of Patent: Jan. 2, 2024

(54) INSECTICIDAL POLYPEPTIDES AND USE THEREOF

(71) Applicant: EVOGENE LTD., Rehovot (IL)

(72) Inventors: Or Rotem, Rehovot (IL); Moshe Elbaz, Ruhama (IL); Michal Simovitch Etkes, Ashdod (IL); Lisa N. Meihls, St. Ann, MO (US); Noam Ben Naim, Ness Ziona (IL); Dhritiman Ghosh, Saint Peters, MO (US)

(73) Assignee: EVOGENE LTD., Rehovot (IL)

( * ) Notice: Subject to any disclaimer, the term of this patent is extended or adjusted under 35 U.S.C. 154(b) by 258 days.

(21) Appl. No.: 17/052,335

(22) PCT Filed: May 2, 2019

(86) PCT No.: PCT/IL2019/050488
§ 371 (c)(1),
(2) Date: Nov. 2, 2020

(87) PCT Pub. No.: WO2019/211850
PCT Pub. Date: Nov. 7, 2019

(65) Prior Publication Data
US 2021/0171976 A1 Jun. 10, 2021

Related U.S. Application Data

(60) Provisional application No. 62/666,138, filed on May 3, 2018.

(51) Int. Cl.
| | |
|---|---|
| *C12N 15/82* | (2006.01) |
| *A01N 63/50* | (2020.01) |
| *C07K 14/195* | (2006.01) |
| *A01N 63/20* | (2020.01) |
| *A01N 37/46* | (2006.01) |

(52) U.S. Cl.
CPC ......... *C12N 15/8286* (2013.01); *A01N 37/46* (2013.01); *A01N 63/20* (2020.01); *A01N 63/50* (2020.01); *C07K 14/195* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 6,083,499 A | 7/2000 | Narva | |
| 10,787,679 B2 * | 9/2020 | Parks | ................. C12N 15/8285 |
| 2003/0106093 A1 | 6/2003 | Narva | |
| 2003/0131378 A1 | 7/2003 | Aroian | |
| 2003/0204868 A1 | 10/2003 | Collmer | |

FOREIGN PATENT DOCUMENTS

| | | | |
|---|---|---|---|
| WO | 0114417 A2 | 3/2001 | |
| WO | 03087144 A2 | 10/2003 | |

OTHER PUBLICATIONS

Baltrus et al (2012, GenBank EGH30980, https://www.ncbi.nlm.nih.gov/ protein/EGH30980).*
Argolo-Filho et al, 2014, Insects 5:62-91.*
Deist et al, 2014, Toxins 6:3005-3027.*
Henriksen et al (2015, GenBank Accession No. CP009505, https://www.ncbi.nlm.nih.gov/nuccore/805342629.*
Henriksen et al (2015, GenBank Accession No. AKB25582, https://www.ncbi.nlm.nih.gov/protein/AKB25582.1).*
Broekgaarden C.; An array of responses to insect feeding in *Brassica*. PhD thesis, Wageningen University, The Netherlands, 2008. 132 pages.
Felsenstein (1985) Confidence limits on phylogenies: an approach using the bootstrap. Evolution 39(4): 783-791.
Ffrench-Constant et al., (2007) Insecticidal toxins from *Photorhabdus* bacteria and their potential use in agriculture. Toxicon 49(4): 436-451.
James C. (2012) Global Status of Commercialized Biotech/GM Crops: 2012. ISAAA Brief No. 44. 329 pages.
James C (2015) Global Status of Commercialized Biotech/GM Crops: 2014. ISAAA Briefs, brief 49. 270 pages.
Jones et al., (2014) InterProScan 5: genome-scale protein function classification. Bioinformatics 30(9): 1236-1240.
Katoh and Standley (2013) MAFFT multiple sequence alignment software version 7: improvements in performance and usability. Mol Biol Evol 30(4): 772-780.
Kumar et al., (2016) MEGA7: Molecular Evolutionary Genetics Analysis Version 7.0 for Bigger Datasets. Mol Biol Evol 33(7): 1870-1874.
Mitchell et al., (2015) The InterPro protein families database: the classification resource after 15 years. Nucleic Acids Res 43(Database issue): D213-D221.
Papkou et al., (2019) The genomic basis of Red Queen dynamics during rapid reciprocal host-pathogen coevolution. Proc Natl Acad Sci U S A 116(3): 923-928.
Saitou and Nei (1987) The neighbor-joining method: a new method for reconstructing phylogenetic trees. Mol Biol Evol 4(4): 406-425.
Sardana et al., (1996) Construction and rapid testing of synthetic and modified toxin gene sequences CryIA (b&c) by expression in maize endosperm culture. Plant Cell Rep 15(9): 677-681.

(Continued)

*Primary Examiner* — Anne Kubelik
(74) *Attorney, Agent, or Firm* — RAPHAEL BELLUM PLLC

(57) ABSTRACT

The present invention relates to isolated and recombinant polynucleotides encoding polypeptides having insecticidal activity and to host cells comprising same. The invention further relates to the use of the insecticidal proteins and/or nucleic acid sequences encoding same for killing or inhibiting the development of insect pests as well as for conferring insect resistance to plants. The invention further provides compositions comprising the pesticidal polypeptides and/or polynucleotide encoding same and host cells, particularly bacterial cells, expressing the insecticidal polypeptides.

9 Claims, 13 Drawing Sheets

Specification includes a Sequence Listing.

(56) References Cited

OTHER PUBLICATIONS

Wu et al., (2007) Evidence for positive Darwinian selection of Vip gene in Bacillus thuringiensis. J Genet Genomics 34(7): 649-660.
Zuckerkandl and Pauling (1965) Evolutionary Divergence and Convergence in Proteins. Evolving Genes and Proteins A Symposium Held at the Institute of Microbiology of Rutgers: the State University with Support from the National Science Foundation. pp. 97-166.
Database NCBI [Online] May 23, 2014 (May 23, 2014). Hypothetical protein [Pseudomonas syringae], NCBI Reference Sequence: WP_024683785.1. URL: https://www.ncbi.nlm.nih.gov/protein/WP_024683785.1?report=genbank&log$=protalign&blast_rank=1&RID=NJ7KSD0X015; retrieved on Aug. 22, 2019. 2 pages.
International Search Report issued for PCT/FR2003/001238 (WO03087144) dated Oct. 20, 2003; 7 pages.

* cited by examiner

INSECTICIDAL POLYPEPTIDES AND USE THEREOF

FIELD OF THE INVENTION

The present invention relates to isolated and recombinant polynucleotides encoding polypeptides having insecticidal activity. The invention further relates to the use of the insecticidal proteins and/or nucleic acid sequences encoding same for killing or inhibiting the development of insect pests as well as for conferring insect resistance to plants, and to compositions comprising the insecticidal polypeptides and use thereof.

BACKGROUND OF THE INVENTION

In modern agriculture, there is a recognized need for elimination of pests from plant fields without exposing the plants to toxic compounds which cause undesirable environmental and safety concerns.

Crops such as corn, rice, wheat, canola and soybean account for over half of the total human caloric intake, either through direct consumption of the seeds or through consumption of meat products of farm animals raised on processed seeds or forage. Seeds are also a source of sugars, proteins and oils and metabolites used in industrial processes. Vegetable or seed oils are a major source of energy and nutrition in human and animal diet. They are also used for the production of industrial products, such as paints, inks and lubricants. In addition, plant oils represent renewable sources of long-chain hydrocarbons which can be used as fuel.

Insect pests are a major factor in the loss of agricultural crops worldwide. For example, the Lepidopteran species fall armyworm, black cutworm and European corn borer inflict damage that can be economically devastating to maize producers. Insect pest-related crop loss as a result of European corn borer attacks on sweet corn fields alone has reached about one billion dollars a year in damage and control expenses.

The European corn borer (*Ostrinia nubilalis*), also known as the European high-flyer, is a moth of the family Crambidae which includes other grass moths. It is a pest of grain, particularly corn (maize or *Zea mays*) and varieties of millet, including broom corn. European corn borer caterpillars damage corn by chewing tunnels through many parts of the plant, thus decreasing agricultural yield. While the European corn borer is native to Europe since its initial discovery in the Americas, the insect has spread into Canada and westward across the United States to the Rocky Mountains.

Fall armyworm (*Spodoptera frugiperda*) is a species in the order of Lepidoptera, of the Noctuidae family, and is the larval life stage of a fall armyworm moth. The fall armyworm mainly attacks maize crops, and is capable of completely destroying maize fields. Remarkable characteristic of the larva is that they practice cannibalism. The fall armyworm is active in the late summer in the southern part of the United States, and early fall in the northern regions.

Another Noctuidae species, the Cabbage looper (*Trichoplusia ni*) is a destructive crop pest in North America. During the larval stage, the pest eats three-times its body weight in plant material a day. Thus, once established in a crop field, the cabbage looper is difficult to control.

The Noctuidae species Soybean looper (*Chrysodeixis includens*), is widely spread from Southern Quebec and Southern Ontario through the eastern and southern part of the United States to Central America and South America, the Antilles and the Galapagos Islands. The larvae feed on a wide range of plants of the families Asteraceae, Brassicaceae, Commelinaceae, Euphorbiaceae, Fabaceae, Geraniaceae, Lamiaceae, Lauraceae, Malvaceae, Solanaceae, and Verbenaceae, and particularly on *Medicago sativa, Phaseolus polystachios, Glycine max, Gossypium herbaceum, Nicotiana tabacum, Lycopersicum esculentum, Brassica* and *Lactuca sativa*.

Black cutworm (*Agrotis ipsilon*), another Noctuidae species, attack corn in the Midwest USA. The moths are attracted to early spring vegetation, are active at night and prefer to deposit their eggs on low-growing, dense vegetation. It is noted that a single black cutworm larva is capable of cutting approximately four corn plants during its lifetime, depending on the size of the plants.

Corn earworm (*Helicoverpa zea*), also referred to as cotton bollworm and the tomato fruitworm, is a major agricultural Noctuidae pest, which feeds on many different plants and crops (polyphagous). The species is widely distributed across the Americas with the exception of northern Canada and Alaska. It migrates seasonally, at night, and can be carried downwind up to 400 km. Pupae can make use of diapause to wait out adverse environmental conditions, especially at high latitudes and in drought. The corn earworm has become resistant to many pesticides, and current techniques attempting to control this species include deep ploughing, trap crops, chemical control using mineral oil, and biological controls.

Egyptian cotton leafworm (*Spodoptera littoralis*), also referred to as the African cotton leafworm or Mediterranean Brocade, is another highly polyphagous species of moth in the family Noctuidae. It is found widely in Africa, Mediterranean Europe and Middle Eastern countries. It was assigned the label of A2 quarantine pest by the European and Mediterranean Plant Protection Organization (EPPO) and was cautioned as a highly invasive species in the United States. Although control with insecticides is possible, there have been many cases of resistance and the lack of available biological control methods means that introduction of *S. littoralis* into glasshouses could necessitate insecticide treatments that could interfere with existing biological control of other pests.

The coleopteran species Western corn rootworm (*Diabrotica virgifera virgifera*) is one of the most devastating corn rootworm species in North America. Corn rootworm larvae can destroy significant percentages of corn if left untreated. In the United States, current estimates show that 30,000,000 acres of corn are infested with corn rootworm, causing about 1 billion USD in lost revenue each year.

The hemipteran species *Nezara viridula*, commonly known as the Southern green stink bug (USA), Southern green shield bug (UK) or Green vegetable bug (Australia and New Zealand), is a plant-feeding stink bug which can be found around the world. Because of its preference for certain species of legumes, such as beans and soybeans, it has a significant economic effect in the growth of such crops. *Nezara viridula* reproduces throughout the year in tropic areas. In temperate zones this species presents a reproductive winter diapause, associated with a reversible change of body coloration from green to brown or russet.

While intensive application of synthetic chemical insecticides was relied upon as a pest control agent in agriculture using broad-spectrum chemical insecticides, concerns were raised for the potential use of hazardous pesticides on the environment and of human health. Accordingly, regulators have banned or limited the use of some of the more hazardous pesticides that were traditionally employed on plant fields. In addition, emerging insect resistance issues stimulated the research and development of biological pesticides, including the discovery and use of various entomopathogenic bacteria.

The control paradigm shifted for using entomopathogenic bacteria, especially bacteria belonging to the genus *Bacillus*, as biological pest control agents. Strains of the bacterium *Bacillus thuringiensis* (Bt) have been used as a source for insecticidal proteins since it was discovered that Bt strains show a high toxicity against specific insects. Bt strains are known to produce delta-endotoxins that are localized within parasporal crystalline inclusion bodies at the onset of sporulation and during the stationary growth phase, and are also known to produce secreted insecticidal proteins. Upon ingestion by a susceptible insect, delta-endotoxins as well as secreted toxins exert their effects at the surface of the midgut epithelium, disrupting the cell membrane, leading to cell disruption and death. Genes encoding insecticidal proteins have also been identified in bacterial species other than Bt, including other bacilli and a diversity of other bacterial species, such as *Brevibacillus laterosporus, Lysinibacillus sphaericus* and *Paenibacillus popilliae*. Insect pathogenicity has also been attributed to strains of *B. larvae, B. lentimorbus, B. sphaericus* and *B. cereus*. Insecticidal binary and ternary heterocomplexes were also described in the art (e.g., as discussed in French-Constant R H et al., 2007. Toxicon. 49(4):436-51. "Insecticidal toxins from *Photorhabdus* bacteria and their potential use in agriculture").

Crop plants have been developed with enhanced insect resistance by genetically engineering crop plants to produce pesticidal proteins from *Bacillus*. These genetically engineered crops are now widely used in American agriculture and have provided producers with an environmentally friendly alternative to traditional insect-control methods. For example, in 2012, 26.1 million hectares were planted with transgenic crops expressing Bt toxins (James, C. "Global Status of Commercialized Biotech/GM Crops: 2012". ISAAA Brief No. 44). However, while they have proven to be very successful commercially, these genetically engineered, insect-resistant (or insect-protected) crop plants typically provide resistance to only a narrow range of economically important pests.

In addition, the global use of transgenic insect-protected crops and the limited variety of insecticidal proteins used in these crops has created a selection pressure for existing insect alleles that impart resistance to the currently-utilized insecticidal proteins. Due to the development of resistance in target pests to insecticidal proteins there is a continuing need for discovery and development of new forms of insecticidal proteins that are useful for managing the increase in insect resistance to transgenic crops expressing insecticidal proteins. New insecticidal proteins with improved efficacy and which exhibit control over a broader spectrum of susceptible insect pest species will reduce the number of surviving insect pests which can develop resistance alleles. In addition, the use of two or more transgenic insecticidal proteins toxic to the same insect pest and displaying different modes of action in one plant may reduce the probability of resistance development in any single target insect pest species.

SUMMARY OF THE INVENTION

The present invention relates to the field of proteinaceous insecticides. The present invention discloses polypeptides of bacterial origin which are active in killing or inhibiting the development of insect pests, particularly plant insect pests.

The present invention further discloses insecticidal polypeptide combinations, particularly of binary order, showing, as a composite, enhanced insecticidal activity compared to the activity of standalone polypeptides, and polypeptides having modes of action not hitherto provided by commercial insect control compositions. The present invention thus provides isolated and recombinant insecticidal polypeptides, polynucleotides encoding same, plants and parts thereof comprising recombinant polynucleotides encoding the insecticidal polypeptides, and composition comprising the insecticidal polypeptides or bacteria comprising same.

According to an aspect of some embodiments of the present invention there is provided an isolated polypeptide comprising an amino acid sequence at least 70% identical to an amino acid sequence selected from the group consisting of SEQ ID NOs:440, 986, 1172-1173, 409-439, 441-503, 942-985, 987-1073, 1143-1171, and 1174-1211, fragments and variants thereof, wherein the insecticidal polypeptide, the fragment or variant thereof and/or a combination of said polypeptides, fragments or variants thereof is capable of killing or inhibiting the development of an insect pest.

According to an aspect of some embodiments of the present invention there is provided an isolated polypeptide comprises an amino acid sequence having 90% local identity over 80% coverage to an amino acid sequence selected from the group consisting of SEQ ID NOs:440, 986, 1172-1173, 409-439, 441-503, 942-985, 987-1073, 1143-1171, and 1174-1211, fragments and variants thereof, wherein the insecticidal polypeptide, the fragment or variant thereof and/or a combination of said polypeptides, fragments or variants thereof is capable of killing or inhibiting the development of an insect pest.

According to certain embodiments, the isolated polypeptide comprises an endogenous signal peptide.

According to certain embodiments, the isolated polypeptide fragment is devoid of the endogenous signal peptide. According to these embodiments, the isolated polypeptide fragment comprises the amino acid sequence set forth in any one of SEQ ID NOs:1212-1246.

According to certain embodiments, the isolated polypeptide fragment is operably linked to a heterologous transit peptide and/or a signal peptide.

According to an aspect of the present invention there is provided an isolated or recombinant polynucleotide encoding a polypeptide comprising an amino acid sequence at least 70% identical to an amino acid sequence selected from the group consisting of SEQ ID NOs:440, 986, 1172-1173, 409-439, 441-503, 942-985, 987-1073, 1143-1171, and 1174-1211, fragments and variants thereof, wherein the polypeptide, the fragment or variant thereof and/or a combination of said polypeptides, fragments or variant thereof is capable of killing or inhibiting the development of an insect.

According to certain embodiments, the polypeptide is encoded by a polynucleotide having a nucleic acid sequence selected from the group consisting of SEQ ID NOs:32, 854, 1103-1104, 1-31, 33-408, 810-853, 855-941, 1074-1102, and 1105-1142.

According to certain embodiments, the polypeptide is encoded by a polynucleotide that hybridizes under stringent hybridization conditions to a polynucleotide comprising a nucleic acid sequence selected from the group consisting of SEQ ID NOs:1-408, or to a complementary nucleic acid thereto, wherein the stringent hybridization conditions, under which namely a specific hybrid is formed, non-specific hybrid is never formed. According to certain embodiments, the polynucleotide comprises an endogenous sequence encoding a signal peptide.

According to certain embodiments, the polynucleotide is devoid of an endogenous sequence encoding a signal peptide. According to these embodiments, the polynucleotide optionally comprises a heterologous sequence encoding a transit and/or a signal peptide.

According to an aspect of the present invention, there is provided an isolated insecticidal polypeptide clustering within a monophyletic group I, the isolated insecticidal polypeptide is capable of killing or inhibiting the development of an insect pest, wherein the monophyletic group I comprises a plurality of insecticidal polypeptide leaf nodes, comprising a leaf node having the amino acid sequence set forth in SEQ ID NO:432; a leaf node having the amino acid sequence set forth in SEQ ID NO:482; a leaf node having the amino acid sequence set forth in SEQ ID NO:483; and a leaf node having the amino acid sequence set forth in SEQ ID NO:486.

According to certain embodiments, the monophyletic group I further comprises at least one additional insecticidal polypeptide leaf node having an amino acid sequence selected from the group consisting of SEQ ID NOs:484-485, 547-554, 725-759, and any combination thereof. According to some embodiments, the monophyletic group I further comprises insecticidal polypeptide leaf nodes having the amino acid sequences set forth in SEQ ID NOs:484-485, 547-554, and 725-759.

According to certain embodiments, the insecticidal polypeptide leaf nodes of monophyletic group I comprise at least one domain characterized by an InterPro accession number selected from the group consisting of IPR000209 and IPR036852. According to these embodiments, the isolated insecticidal polypeptide clustering within said monophyletic group I comprises an amino acid sequence exhibiting at least 18% sequence identity to a polypeptide comprising an amino acid sequence selected from the group consisting of SEQ ID NO:432 (designated ICM147), SEQ ID NO:482 (designated ICM147_H5), SEQ ID NO:483 (designated ICM147_H9) and SEQ ID NO:486 (designated ICM147_H36).

According to certain exemplary embodiments, the insecticidal polypeptide leaf nodes of monophyletic group I and the isolated insecticidal polypeptide clustering within same comprise the domains characterized by the InterPro accession numbers IPR000209 and IPR036852.

According to an aspect of the present invention, there is provided an isolated insecticidal polypeptide clustering within a monophyletic group II, the isolated insecticidal polypeptide is capable of killing or inhibiting the development of an insect pest, wherein the monophyletic group II comprises a plurality of insecticidal polypeptide leaf nodes comprising a leaf node having the amino acid sequence set forth in SEQ ID NO:433; and a leaf node having the amino acid sequence set forth in SEQ ID NO:487.

According to certain embodiments, the monophyletic group II further comprises at least one additional insecticidal polypeptide leaf node having an amino acid sequence selected from the group consisting of SEQ ID NOs:555-556, 760-761, and any combination thereof. According to some embodiments, the monophyletic group II further comprises insecticidal polypeptide leaf nodes having the amino acid sequences set forth in SEQ ID NOs: 555-556, and 760-761.

According to certain embodiments, the insecticidal polypeptide leaf nodes of monophyletic group II comprise at least two domains characterized by an InterPro accession number selected from the group consisting of IPR024519, IPR008964, IPR013783, IPR038177 and IPR003535. According to these embodiments, the isolated insecticidal polypeptide clustering within said monophyletic group II comprises an amino acid sequence exhibiting at least 65% identity to a polypeptide comprising an amino acid sequence selected from the group consisting of SEQ ID NOs:433 (designated ICM149) and 487 (designated ICM149_H3).

According to certain exemplary embodiments, the insecticidal polypeptide leaf nodes of said monophyletic group II and the isolated insecticidal polypeptide clustering within same comprise the domains characterized by the InterPro accession numbers IPR024519, IPR008964, IPR013783, IPR038177 and IPR003535.

According to an aspect of the present invention, there is provided an isolated insecticidal polypeptide clustering within a monophyletic group III, the isolated insecticidal polypeptide is capable of killing or inhibiting the development of an insect pest, wherein the monophyletic group III comprises a plurality of insecticidal polypeptide leaf nodes comprising a leaf node having the amino acid sequence set forth in SEQ ID NO:470; and a leaf node having the amino acid sequence set forth in SEQ ID NO:491.

According to certain embodiments, the monophyletic group III further comprises at least one additional insecticidal polypeptide leaf node having an amino acid sequence selected from the group consisting of SEQ ID NOs:702-704, 772-774, and any combination thereof. According to some embodiments, the monophyletic group III further comprises insecticidal polypeptide leaf nodes having the amino acid sequences set forth in SEQ ID NOs:702-704, and 772-774.

According to certain embodiments, the insecticidal polypeptide leaf nodes of monophyletic group III comprise the domains characterized by InterPro accession numbers IPR036716 and IPR005639. According to these embodiments, the isolated insecticidal polypeptide clustering within said monophyletic group III comprises an amino acid sequence exhibiting at least 23% identity to a polypeptide comprising an amino acid sequence selected from the group consisting of SEQ ID NOs:470 (designated ICM495) and 491 (designated ICM495H4).

According to an aspect of the present invention, there is provided an isolated insecticidal polypeptide clustering within a monophyletic group IV, the isolated insecticidal polypeptide is capable of killing or inhibiting the development of an insect pest, wherein the monophyletic group IV comprises a plurality of insecticidal polypeptide leaf nodes comprising a leaf node having the amino acid sequence set forth in SEQ ID NO:425; a leaf node having the amino acid sequence set forth in SEQ ID NO:492, a leaf node having the amino acid sequence set forth in SEQ ID NO:493, a leaf node having the amino acid sequence set forth in SEQ ID NO:494, a leaf node having the amino acid sequence set forth in SEQ ID NO:495, and a leaf node having the amino acid sequence set forth in SEQ ID NO:496.

According to certain embodiments, the monophyletic group IV further comprises at least one additional insecticidal polypeptide leaf node having an amino acid sequence selected from the group consisting of SEQ ID NOs:775-777, and any combination thereof. According to some embodiments, the monophyletic group IV further comprises insecticidal polypeptide leaf nodes having the amino acid sequences set forth in SEQ ID NOs:775-777.

Any method as is known in the art for identification of monophyletic groups by means of construction of phylogenetic trees can be used according to the teachings of the present invention.

According to certain embodiments, the monophyletic group is constructed by a tool selected from the group consisting of MEGA7 software and the neighbor joining method; ProfDist; and Phylip; using default parameters.

According to certain exemplary embodiments, the monophyletic group is constructed by the MEGA7 software and the neighbor joining method, using default parameters.

According to certain embodiments, the insecticidal polypeptide leaf nodes of monophyletic group IV comprise at least two domains characterized by an InterPro accession number selected from the group consisting of IPR003610, IPR013783, IPR036573, IPR014756, IPR004302, IPR036116, IPR003961. According to these embodiments, the isolated insecticidal polypeptide clustering within said monophyletic group IV comprises an amino acid sequence exhibiting at least 26% identity to a polypeptide comprising an amino acid sequence selected from the group consisting of SEQ ID NO:425 (designated ICM86); SEQ ID NO:492 (designated ICM86_H21); SEQ ID NO:493 (designated ICM86_H22); SEQ ID NO:494 (designated ICM86_H23); SEQ ID NO:495 (designated ICM86_H24); and SEQ ID NO:496 (designated ICM86_H27).

According to certain exemplary embodiments, the insecticidal polypeptide leaf nodes of said monophyletic group II and the isolated insecticidal polypeptide clustering within same comprise the domains characterized by the InterPro accession numbers IPR003610, IPR013783, IPR036573, IPR014756, IPR004302, IPR036116, and IPR003961.

The present invention further discloses binary insecticidal systems comprising two polypeptides, wherein each of the polypeptides alone shows reduced or no detectable insecticidal activity compared to insecticidal activity of killing or inhibiting the development of an insect of the binary combination.

According to an aspect of the some embodiments of the present invention there is provided a binary insecticidal system comprising a first polypeptide comprising an amino acid sequence at least 70% identical to SEQ ID NO:409 (designated ICM1) and a second polypeptide comprising an amino acid sequence at least 70% identical to SEQ ID NO:410 (designated ICM2), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:409 and the second polypeptide comprising the amino acid sequence set forth in SEQ ID NO:410.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:489 (designated ICM1_H1) and a second polypeptide comprising an amino acid sequence at least 70% identical to SEQ ID NO:490 (designated ICM2_H1), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:489 and the second polypeptide comprising the amino acid sequence set forth in SEQ ID NO:490.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:418 (designated ICM73) and a second polypeptide comprising an amino acid sequence at least 70% identical to SEQ ID NO:419 (designated ICM74), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:418 and the second polypeptide comprising the amino acid sequence set forth in SEQ ID NO:419.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:421 (designated ICM82) and a second polypeptide comprising an amino acid sequence at least 70% identical to SEQ ID NO:422 (designated ICM83), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:421 and the second polypeptide comprising the amino acid sequence set forth in SEQ ID NO:422.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:423 (designated ICM84), and a second polypeptide comprising an amino acid sequence at least 70% identical to SEQ ID NO:424 (designated ICM85), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:423 and the second polypeptide comprising the amino acid sequence set forth in SEQ ID NO:424.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 95% identical to SEQ ID NO:442 (designated ICM235) and a second polypeptide comprising an amino acid sequence at least 95% identical to SEQ ID NO:443 (designated ICM236), wherein each of the first and the second polypeptides has no detectable insecticidal activity and the binary system shows insecticidal activity of killing or inhibiting the development of an insect pest.

According to currently exemplary embodiments, the first polypeptide comprises the amino acid sequence set forth in SEQ ID NO:442 and the second polypeptide comprises the amino acid sequence set forth in SEQ ID NO:443.

The present invention further provides insecticidal systems comprising three polypeptides, wherein each of the polypeptides alone shows reduced or no detectable insecticidal activity compared to insecticidal activity of killing or inhibiting the development of an insect of the ternary combination.

According to an aspect of the some embodiments of the present invention there is provided a ternary insecticidal system comprising a first polypeptide comprising an amino acid sequence at least 70% identical to SEQ ID NO:462 (designated ICM457), a second polypeptide comprising an amino acid sequence at least 70% identical to SEQ ID NO:463 (designated ICM458), and a third polypeptide comprising an amino acid sequence at least 70% identical to SEQ ID NO:464 (designated ICM459), wherein insecticidal activity of killing or inhibiting the development of an insect pest of the ternary system is significantly elevated compared to the insecticidal activity of each of the first, the second and the third polypeptides alone. According to currently exemplary embodiments, the first polypeptide comprises the amino acid sequence set forth in SEQ ID NO:462, the second polypeptide comprises the amino acid sequence set forth in SEQ ID NO:463, and the third polypeptide comprises the amino acid sequence set forth in SEQ ID NO:464.

According to certain embodiments, each of the first and the second polypeptides has no detectable insecticidal activity individually.

The insecticidal isolated polypeptides and the binary or ternary insecticidal systems of the present invention can be expressed within a plant cell(s) or can be applied to a plant or a part thereof. The polypeptides and systems of the present invention can be applied to the plant in an isolated form or can be present within bacteria expressing same.

According to an aspect of some embodiments of the present invention there is provided an insecticidal composition comprising at least one isolated polypeptide or at least one combination of the isolated polypeptides capable of killing or inhibiting the development of an insect pest, wherein said isolated polypeptide comprises an amino acid sequence at least 70% identical to an amino acid sequence selected from the group consisting of SEQ ID NOs:440, 986, 1172-1173, 409-439, 441-503, 942-985, 987-1073, 1143-1171, and 1174-1211, fragment or variant thereof, the composition further comprises at least one agent selected from the group consisting of: a carrier, a stabilizer, a diluent, a surfactant, and a mineral.

According to some embodiments, the insecticidal composition comprises a combination of at least two and no more than five isolated polypeptides. According to certain exemplary embodiments, the insecticidal composition comprises at least one of the binary systems of the invention. According to certain exemplary embodiments, the insecticidal composition comprises the ternary systems of the invention.

According to an aspect of some embodiments of the present invention there is provided an insecticidal composition comprising at least one bacterial cell expressing at least one polypeptide comprising an amino acid sequence at least 70% identical to an amino acid sequence selected from the group consisting of SEQ ID NOs:440, 986, 1172-1173, 409-439, 441-503, 942-985, 987-1073, 1143-1171, and 1174-1211, fragment or variant thereof, or a combination thereof, wherein the at least one polypeptide or the at least one combination is expressed in an amount capable of killing or inhibiting the development of an insect pest. It is to be explicitly understood that the amount of the expressed polypeptide or combination thereof within the composition is higher than the amount in a corresponding bacterial composition found in nature.

According to some embodiments, the composition is a culture medium. According to some embodiments, the composition further comprises at least one agriculturally acceptable agent selected from the group consisting of a carrier, a stabilizer, a diluent, a surfactant, and a mineral.

According to an aspect of some embodiments of the present invention there is provided a genetically modified bacterial strain expressing at least one polypeptide comprising an amino acid sequence at least 70% identical to an amino acid sequence selected from the group consisting of SEQ ID NOs:440, 986, 1172-1173, 409-439, 441-503, 942-985, 987-1073, 1143-1171, and 1174-1211, fragment or variant thereof.

According to an aspect of some embodiments of the present invention there is provided a genetically modified bacterial strain expressing at least one insecticidal polypeptide clustering with any one of monophyletic groups I-IV according to some embodiments of the present invention.

According to certain embodiments, the genetically modified bacterial strain expresses a combination of at least two and no more than five polypeptides of some embodiments of the invention. According to certain exemplary embodiments, the genetically modified bacterial strain expresses at least one of the binary systems of the invention. According to certain exemplary embodiments, the insecticidal composition comprises the ternary systems of the invention.

According to an aspect of some embodiments of the present invention there is provided a lysate of at least one bacterial cell expressing at least one polypeptide according to the teachings of the present invention.

According to certain embodiments, the at least one bacterial cell is genetically modified.

According to certain embodiments, the lysate is of a plurality of the bacterial cells. According to some embodiments, the lysate comprises a whole cell lysate of the bacterial cells. According to some embodiments, the lysate comprises soluble fraction of the bacterial cells. According to some embodiments of the invention, the lysate comprises inclusion bodies of the bacterial cells.

According to certain embodiments, the lysate is of bacterial cells of the same bacterial species and/or strain. According to certain embodiments, the lysate is of bacterial cells of different species and/or strains. According to these embodiments, the lysate is of no more than one hundred bacterial species and/or strains.

According to an aspect of the present invention, there is provided a culture medium comprising at least one bacterial strain expressing at least one insecticidal polypeptide according to some embodiments of the invention. The at least one insecticidal polypeptide can be retained within the bacterial cells and/or excreted to the medium. It is to be explicitly understood that a culture medium comprising at least one insecticidal polypeptide excreted from the at least one bacterial strain of the invention is encompassed within the scope of the present invention.

According to an aspect of some embodiments of the present invention there is provided an insecticidal composition comprising at least one bacterial strain of some embodiments of the present invention, a lysate thereof, or a culture medium comprising same wherein the composition further comprises at least one agent selected from the group consisting of: a carrier, a stabilizer, a diluent, a surfactant, and a mineral, suitable for use in agriculture.

The at least one bacterial strain can be in a form selected from the group consisting of live cells, dead cell, sporulating cells, spores and any combination thereof.

According to some embodiments of the invention, the composition comprises a proteinaceous preparation of the at least one bacterial strain. According to certain exemplary embodiments, the proteinaceous matter comprises more than 50% protein (weight/weight).

According to certain embodiments, the composition is formulated in accordance with conventional techniques for application to an environment hosting a target insect pest, e.g., soil, water, and foliage of plants. According to certain embodiments, the insecticidal composition is in a form selected from the group consisting of a liquid form, a dehydrated form, and a lyophilized form.

According to certain exemplary embodiments, the composition is provided in a container.

According to an aspect of some embodiments of the present invention there is provided a nucleic acid construct comprising an isolated polynucleotide comprising at least one nucleic acid sequence encoding at least one polypeptide of some embodiments of the invention, operably linked to at least one regulatory element. According to certain embodiments, the regulatory element is a promoter capable of directing transcription of nucleic acid sequence in a host cell.

According to certain embodiments, the promoter is heterologous to the nucleic acid sequence. According to certain embodiments, the promoter is endogenous to the nucleic acid sequence.

According to some embodiments, the promoter is endogenous to the host cell. According to some embodiments, the promoter is heterologous to the host cell.

According to an aspect of some embodiments of the present invention there is provided a composition comprising the nucleic acid construct of some embodiments of the invention.

According to an aspect of some embodiments of the present invention there is provided an isolated cell being transformed with the nucleic acid construct of some embodiments of the invention.

According to certain embodiments, the cell is a plant cell.

According to certain embodiments, the cell is a bacterial cell.

According to certain embodiments, the cell is a yeast cell.

According to an aspect of some embodiments of the present invention there is provided a plant comprising at least one cell transformed with the nucleic acid construct of some embodiments of the invention.

According to an aspect of some embodiments of the present invention there is provided an insecticidal composition comprising the isolated cell(s) of some embodiments of the invention.

According to an aspect of some embodiments of the present invention there is provided a kit comprising the insecticidal composition of some embodiments of the present invention, and instructions for using the composition in killing or inhibiting the development of an insect pest.

According to an aspect of some embodiments of the present invention there is provided a method of increasing a resistance of a plant to an insect pest, comprising expressing within at least one cell of the plant at least one isolated polypeptide of some embodiments of the invention, or transforming the plant with the nucleic acid construct of some embodiments of the invention.

According to an aspect of some embodiments of the present invention there is provided a method of increasing a resistance of a plant to an insect pest, comprising contacting the plant or a part thereof with the bacterial cell of some embodiments of the invention, the lysate of some embodiments of the invention, the isolated polypeptide of some embodiments of the invention, and/or composition comprising same, thereby increasing the resistance of the plant to the insect.

According to some embodiments of the invention, the killing or the inhibiting development of the insect is affected by per os administration of the isolated polypeptide(s), the nucleic acid construct(s) encoding same, the cell(s) expression said polypeptide(s) or lysate thereof or a composition comprising same into the insect.

According to some embodiments of the invention, the insect is from an order selected from the group consisting of Lepidoptera, Coleoptera or Hemiptera.

According to some embodiments of the invention, wherein when the insect is from the order Lepidoptera, said insect is selected from the group consisting of Black cutworm (BCW, *Agrotis ipsilon*), Corn earworm (CEW, *Helicoverpa zea*), Egyptian cotton leafworm (CLW, *Spodoptera littoralis*), European corn borer (ECB, *Ostrinia nubilalis*), Fall armyworm (FAW, *Spodoptera frugiperda*), Soybean looper (SBL, *Chrysodeixis includens*), and Cabbage looper (CL, *Trichoplusia ni*).

According to some embodiments of the invention, wherein when the insect is from the order Coleoptera, said insect is selected from the group consisting of the Western corn rootworm (WCR, *Diabrotica virgifera virgifera*).

According to some embodiments of the invention, wherein when the insect is from the order Hemiptera, said insect is the Southern green stink bug (STK, *Nezara viridula*).

According to some embodiments of the invention, wherein when the insect is the Black cutworm (BCW), the plant is of a plant family selected from the group consisting of: Malvaceae, Poaceae, Liliaceae, Apiaceae, Fabaceae, Solanaceae, Chenopodiaceae, Brassicaceae, Theaceae, Solanaceae, Asteraceae, Chenopodiaceae, Cucurbitaceae, Rubiaceae, Convolvulaceae, Cucurbitaceae, Asteraceae, Apiaceae, Rosaceae, Ginkgoaceae, Iridaceae, Fabaceae, Malvaceae, Asteraceae, Poaceae, Convolvulaceae, Chenopodiaceae, Euphorbiaceae, Lamiaceae, Musaceae, Solanaceae, Papaveraceae, Pedaliaceae, Lamiaceae, Vitaceae, and Zingiberaceae.

According to some embodiments of the invention, wherein when the insect is the CEW, the plant is of a plant family selected from the group consisting of: Malvaceae, Amaranthaceae, Brassicaceae, Solanaceae, Chenopodiaceae, Rutaceae, Cucurbitaceae, Rosaceae, Geraniaceae, Asteraceae, Malvaceae, Asteraceae, Convolvulaceae, Asteraceae, Lamiaceae, Caprifoliaceae, Solanaceae, Salicaceae, Solanaceae, Chenopodiaceae, Fabaceae, and Poaceae.

According to some embodiments of the invention, wherein when the insect is the Egyptian cotton leafworm (CLW), the plant is of a plant family selected from the group consisting of: Malvaceae, Actinidiaceae, Liliaceae, Amaranthaceae, Ranunculaceae, Scrophulariaceae, Apiaceae, Chenopodiaceae, Brassicaceae, Araceae, Asteraceae, Theaceae, Cannaceae, Solanaceae, Casuarinaceae, Cucurbitaceae, Rutaceae, Rubiaceae, Convolvulaceae, Tiliaceae, Taxodiaceae, Caryophyllaceae, Myrtaceae, Euphorbiaceae, Moraceae, Rosaceae, Iridaceae, Convolvulaceae, Euphorbiaceae, Verbenaceae, Lamiaceae, Musaceae, Cactaceae, Lauraceae, Arecaceae, Piperaceae, Salicaceae, Portulacaceae, Myrtaceae, Punicaceae, Fagaceae, Brassicaceae, Euphorbiaceae, Pedaliaceae, Chenopodiaceae, Lamiaceae, Sterculiaceae, Poaceae, Verbenaceae, Fabaceae, Violaceae, and Vitaceae.

According to some embodiments of the invention, wherein when the insect is the European corn borer (ECB), the plant is of a plant family selected from the group consisting of: Amaranthaceae, Asteraceae, Solanaceae, Fabaceae, Malvaceae, Cannabaceae, Rosaceae, Salicaceae, and Poaceae.

According to some embodiments of the invention, wherein when the insect is Fall armyworm (*Spodoptera frugiperda*), the plant is of a plant family selected from the group consisting of: Amaranthaceae, Apiaceae, Apocynaceae, Asteraceae, Brassicaceae, Caryophyllaceae, Chenopodiaceae, Convolvulaceae, Cucurbitaceae, Cyperaceae, Euphorbiaceae, Fabaceae, Geraniaceae, Iridaceae, Juglandaceae, Liliaceae, Malvaceae, Musaceae, Platanaceae, Poaceae, Poaceae, Polygonaceae, Portulacaceae, Rosaceae, Rutaceae, Solanaceae, Ericaceae, Violaceae, Vitaceae, and Zingiberaceae.

According to some embodiments of the invention, wherein when the insect is the Soybean Looper (*Chrysodeixis includens*), the plant is of a plant family selected from the group consisting of: Amaranthaceae, Apiaceae, Araceae, Araliaceae, Asteraceae, Begoniaceae, Brassicaceae, Caryophyllaceae, Chenopodiaceae, Convolvulaceae, Cucurbitaceae, Euphorbiaceae, Fabaceae, Geraniaceae, Gesneriaceae, Hydrangeaceae, Lamiaceae, Lauraceae, Liliaceae, Malvaceae, Passifloraceae, Piperaceae, Poaceae, Polygonaceae, Portulacaceae, Rubiaceae, and Solanaceae.

According to some embodiments of the invention, wherein when the insect is the Cabbage Looper (*Trichoplusia ni*), then the plant is from a plant family selected from the group consisting of: crucifers (e.g., broccoli, cabbage, cauliflower, Chinese cabbage, collards, kale, mustard, radish, rutabaga, turnip, and watercress), beet, cantaloupe, celery, cucumber, lima bean, lettuce, parsnip, pea, pepper, potato, snap bean, spinach, squash, sweet potato, tomato, watermelon, *chrysanthemum*, hollyhock, snapdragon, sweetpea, cotton, tobacco, *Chenopodium album, Lactuca* spp. (wild lettuce), *Taraxacum* officinale (dandelion), and *Rumex crispus* (curly dock).

According to some embodiments of the invention, wherein when the insect is Western corn rootworm (*Diabrotica virgifera virgifera*), the plant is from a plant family selected from the group consisting of: Asteraceae, Cucurbitaceae, Fabaceae, and Poaceae.

According to some embodiments of the invention, wherein when the insect is the Southern green stink bug (STK), the plant is from a plant family selected from the group consisting of: Malvaceae, Scrophulariaceae, Fabaceae, Chenopodiaceae, Brassicaceae, Solanaceae, Juglandaceae, Rutaceae, Cucurbitaceae, Malvaceae, Asteraceae, Poaceae, Convolvulaceae, Oleaceae, Caprifoliaceae, Proteaceae, Magnoliaceae, Euphorbiaceae, Brassicaceae, Passifloraceae, Scrophulariaceae, Lauraceae, Anacardiaceae, Euphorbiaceae, Rosaceae, Pedaliaceae, Asteraceae, and Sterculiaceae.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In addition, the materials, methods, and examples are illustrative only and are not intended to be necessarily limiting. Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

DETAILED DESCRIPTION OF THE INVENTION

Figure 1A:
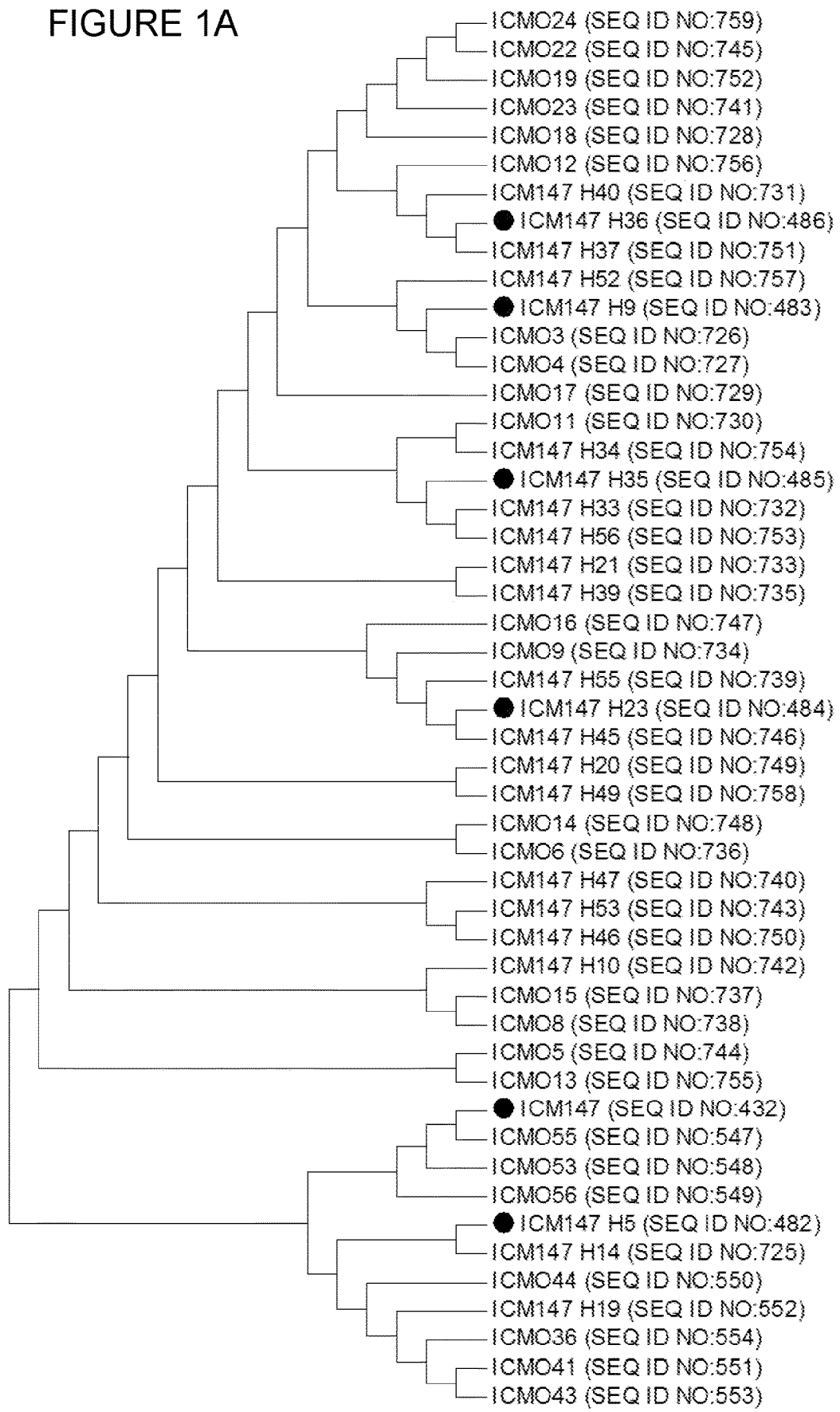
FIGS. 1A-D show phylogenetic trees for the monophyletic groups I-IV (FIG. 2A, FIG. 2B, FIG. 2C and FIG. 2D, respectively). Phylogenetic trees were constructed based on protein sequence alignment generated by MAFFT version 7 (Katoh K and Standley D M. "MAFFT Multiple Sequence Alignment Software Version 7: Improvements in Performance and Usability." Molecular Biology and Evolution 30(4) (2013):772-780. PMC. Web. 19 Jul. 2018), utilizing MEGA7 software (Kumar, S., Stecher, G., & Tamura, K. (2016). MEGA7: Molecular Evolutionary Genetics Analysis version 7.0 for bigger datasets. Mol. Biol. Evol. 33(7):1870-1874) and neighbor joining method (Saitou N, Nei M. "The neighbor-joining method: a new method for reconstructing phylogenetic trees." Molecular Biology and Evolution, volume 4(4), pp. 406-425, July 1987). Leaves are denoted as gene names and SEQ ID NOs. of the polypeptide. The SEQ ID NOs. having a validated insecticidal activity (as described herein, Examples 8-9) are marked with black dots.

The present invention relates to bacterial genes encoding polypeptides wherein the polypeptides or combination thereof are useful as insecticidal compounds capable of killing or in inhibiting the development of various insect pests. The present invention further provides constructs comprising polynucleotides encoding the polypeptides and cells comprising same, as well as compositions and methods for killing or inhibiting developments of various insect pests, particularly plant pests.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

According to an aspect of some embodiments of the present invention there is provided an isolated polypeptide comprising an amino acid sequence at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs:440, 986, 1172-1173, 409-439, 441-503, 942-985, 987-1073, 1143-1171, and 1174-1211, fragments and variants thereof, wherein the polypeptide, the fragment or variant thereof and/or a combination of said polypeptides, fragments or variants thereof is capable of killing or inhibiting the development of an insect pest.

The term "isolated" refers to at least partially separated from the natural environment e.g., from a plant cell or from a bacterium cell.

According to a further aspect of certain embodiments of the present invention there is provided an isolated polypeptide, a variant or a fragment thereof comprising an amino acid sequence which comprises at least two domains characterized by an InterPro accession number selected from the group consisting of: IPR000209, IPR000259, IPR000757, IPR000772, IPR000909, IPR001343, IPR001611, IPR001826, IPR001842, IPR003137, IPR003344, IPR003386, IPR003535, IPR003540, IPR003591, IPR003610, IPR003730, IPR003896, IPR003959, IPR003961, IPR003995, IPR004302, IPR004954, IPR004991, IPR005046, IPR005181, IPR005430, IPR005546, IPR005565, IPR005639, IPR006026, IPR006311, IPR006315, IPR006530, IPR007119, IPR008414, IPR008638, IPR008708, IPR008727, IPR008872, IPR008900, IPR008964, IPR008966, IPR009003, IPR009093, IPR009459, IPR010566, IPR010572, IPR011049, IPR011050, IPR011083, IPR011324, IPR011658, IPR011889, IPR012332, IPR012334, IPR012413, IPR013320, IPR013425, IPR013686, IPR013783, IPR013858, IPR014756, IPR015500, IPR017946, IPR018003, IPR018337, IPR018511, IPR019948, IPR021862, IPR022385, IPR022398, IPR023828, IPR024079, IPR024519, IPR024769, IPR025968, IPR026444, IPR027268, IPR027282, IPR027417, IPR027439, IPR027994, IPR028897, IPR028920, IPR029044, IPR029058, IPR029487, IPR031325, IPR032675, IPR034033, IPR035088, IPR035251, IPR035331, IPR035918, IPR035992, IPR036116, IPR036404, IPR036514, IPR036573, IPR036709, IPR036716, IPR036730, IPR036852, IPR036937, IPR037149, IPR037524, IPR038177, and IPR038371.

According to certain embodiments, the isolated polypeptide comprises an amino acid sequence at least 70% identical to an amino acid sequence selected from the group consisting of SEQ ID NOs:411-414, 416, 418, 420, 422-423, 425, 432-437, 440-442, 445, 447-448, 453, 458-459, 465, 469-470, 473-475, 478, 482-489, 491-496, 498-502, 508-522, 531-533, 537-538, 547-565, 580-597, 603-613, 702-704, 706-707, 725-761, 764-768, 772-777, 779-809, 942, 944-953, 955, 958, 960, 962-963, 965, 972, 974-983, 986-989, 992, 995-997, 1003, 1010-1012, 1022, 1025-1030, 1032-1035, 1037-1040, 1042-1056, 1058-1064, 1066-1071, 1143-1147, 1153-1156, 1162-1169, 1172-1178, 1184-1185, 1190-1193, 1196-1204, 1206-1208, and 1211.

According to certain embodiments, the isolated polypeptide comprising the at least two InterPro domains comprises an amino acid sequence selected from the group consisting of SEQ ID NOs:411-414, 416, 418, 420, 422-423, 425, 432-437, 440-442, 445, 447-448, 453, 458-459, 465, 469-470, 473-475, 478, 482-489, 491-496, 498-502, 508-522, 531-533, 537-538, 547-565, 580-597, 603-613, 702-704, 706-707, 725-761, 764-768, 772-777, 779-809, 942, 944-953, 955, 958, 960, 962-963, 965, 972, 974-983, 986-989, 992, 995-997, 1003, 1010-1012, 1022, 1025-1030, 1032-1035, 1037-1040, 1042-1056, 1058-1064, 1066-1071, 1143-1147, 1153-1156, 1162-1169, 1172-1178, 1184-1185, 1190-1193, 1196-1204, 1206-1208, and 1211.

According to certain embodiments, the isolated fragment comprising the at least two InterPro domains comprises an amino acid sequence at least 70% identical to an amino acid sequence selected from the group consisting of SEQ ID NOs:1212-1213, 1217-1220, 1222, 1226, 1231-1245.

According to certain embodiments, the isolated fragment comprising the at least two InterPro domains comprises an amino acid sequence selected from the group consisting of SEQ ID NOs:1212-1213, 1217-1220, 1222, 1226, 1231-1245.

According to certain embodiments, the isolated polypeptide, variant or fragment thereof comprises at least two, at least three, at least four, at least five, at least six, at least seven, at least eight, at least nine, at least 10 or more domains.

As used herein, a polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability and/or function of a protein. Identified by their high degree of conservation in aligned sequences of a family of protein homologues, they can be used as identifiers to determine if any polypeptide in question belongs to a previously identified polypeptide family.

According to certain embodiments, the polypeptide comprises an endogenous signal peptide.

According to certain embodiments, the polypeptide fragment is devoid of the endogenous signal peptide. According to these embodiments, the insecticidal polypeptide fragment comprises the amino acid sequence set forth in any one of SEQ ID NOs:1212-1246.

According to certain embodiments, the polypeptide fragment is operably linked to a heterologous transit peptide and/or a signal peptide.

According to an aspect of the present invention there is provided an isolated or recombinant polynucleotide encoding a polypeptide comprising an amino acid sequence at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs:440, 986, 1172-1173, 409-439, 441-503, 942-985, 987-1073, 1143-1171, and 1174-1211, fragments and variants thereof, wherein the insecticidal polypeptide, the fragment or variant thereof and/or a combination of said polypeptides, fragments or variant thereof is capable of killing or inhibiting the development of an insect.

According to certain embodiments, the polypeptide is encoded by a polynucleotide having a nucleic acid sequence selected from the group consisting of SEQ ID NOs:32, 854, 1103-1104, 1-31, 33-408, 810-853, 855-941, 1074-1102, and 1105-1142.

According to certain embodiments, the polypeptide is encoded by a polynucleotide that hybridizes under stringent hybridization conditions to a polynucleotide comprising a nucleic acid sequence selected from the group consisting of SEQ ID NOs:1-408 or to a complementary nucleic acid thereto, wherein the stringent hybridization conditions, under which namely a specific hybrid is formed, non-specific hybrid is never formed. For example, such conditions comprise hybridization at at least 42° C. to 45° C. followed by washing at room temperature to 65° C. with 0.2-2×SSC and 0.1% SDS. Alternatively, such conditions comprise hybridization at 65° C. to 70° C. with 1×SSC, followed by washing at 65° C. to 70° C. with 0.3×SSC. Hybridization can be performed by a conventionally known method such as a method described in J. Sambrook et al. Molecular Cloning, A Laboratory Manual, 2nd Ed., Cold Spring Harbor Laboratory (1989).

According to certain embodiments, the polynucleotide is devoid of an endogenous sequence encoding a signal peptide. According to these embodiments, the polynucleotide optionally comprises a heterologous sequence encoding a transit and/or a signal peptide.

The present invention now discloses monophyletic groups (also referred to as "trees") of insecticidal polypeptides. The polypeptides forming the group (the leaf nodes of a monophyletic group) share structural and functional similarities, while not necessarily sharing high sequence identity or homology as exemplified hereinbelow.

Methods for identification of monophyletic groups by means of construction of phylogenetic trees are well-known in the art [Baum, D. (2008) Reading a Phylogenetic Tree: The Meaning of Monophyletic Groups. Nature Education 1(1):190]. Tools for construction and visualization of phylogenetic trees include, but are not limited to, MEGA7 [Molecular Evolutionary Genetics Analysis, version 7.0 (Kumar S, Stecher G, and Tamura K., 2016, "MEGA7: Molecular Evolutionary Genetics Analysis version 7.0 for bigger datasets". Molecular Biology and Evolution 33:1870-

1874)], ProfDist (Bioinformatics, Volume 21, Issue 9, Pages 2108-2109, doi.org/10.1093/bioinformatics/bti289), JalView (jalview.org/) and Phylip (Bioinformatics. 1999 December; 15(12):1068-9).

According to certain embodiments, the monophyletic group is constructed by a tool selected from the group consisting of MEGA7 software and the neighbor joining method; ProfDist; and Phylip; using default parameters.

According to certain exemplary embodiments, the monophyletic group is constructed by the MEGA7 software and the neighbor joining method, using default parameters.

According to an aspect of the present invention, there is provided an isolated insecticidal polypeptide clustering within a monophyletic group I, the isolated insecticidal polypeptide is capable of killing or inhibiting the development of an insect pest, wherein the monophyletic group I comprises a plurality of insecticidal polypeptide leaf nodes, comprising a leaf node having the amino acid sequence set forth in SEQ ID NO:432; a leaf node having the amino acid sequence set forth in SEQ ID NO:482; a leaf node having the amino acid sequence set forth in SEQ ID NO:483; and a leaf node having the amino acid sequence set forth in SEQ ID NO:486.

According to certain embodiments, the monophyletic group I further comprises at least one additional insecticidal polypeptide leaf node having an amino acid sequence selected from the group consisting of SEQ ID NOs:484-485, 547-554, 725-759, and any combination thereof. According to some embodiments, the monophyletic group I further comprises insecticidal polypeptide leaf nodes having the amino acid sequences set forth in SEQ ID NOs:484-485, 547-554, and 725-759.

According to certain embodiments, the insecticidal polypeptide leaf nodes of monophyletic group I comprise at least one domain characterized by an InterPro accession number selected from the group consisting of IPR000209 and IPR036852. According to these embodiments, the isolated insecticidal polypeptide clustering within said monophyletic group I comprises an amino acid sequence exhibiting at least 18% sequence identity to a polypeptide comprising an amino acid sequence selected from the group consisting of SEQ ID NO:432 (designated ICM147), SEQ ID NO:482 (designated ICM147_H5), SEQ ID NO:483 (designated ICM147_H9) and SEQ ID NO:486 designated (ICM147_H36).

According to certain exemplary embodiments, the insecticidal polypeptide leaf nodes of monophyletic group I and the isolated insecticidal polypeptide clustering within same comprise the domains characterized by the InterPro accession numbers IPR000209 and IPR036852.

According to an aspect of the present invention, there is provided an isolated insecticidal polypeptide clustering within a monophyletic group II, the isolated insecticidal polypeptide is capable of killing or inhibiting the development of an insect pest, wherein the monophyletic group II comprises a plurality of insecticidal polypeptide leaf nodes comprising a leaf node having the amino acid sequence set forth in SEQ ID NO:433; and a leaf node having the amino acid sequence set forth in SEQ ID NO:487.

According to certain embodiments, the monophyletic group II further comprises at least one additional insecticidal polypeptide leaf node having an amino acid sequence selected from the group consisting of SEQ ID NOs:555-556, 760-761, and any combination thereof. According to some embodiments, the monophyletic group II further comprises insecticidal polypeptide leaf nodes having the amino acid sequences set forth in SEQ ID NOs:555-556, and 760-761.

According to certain embodiments, the insecticidal polypeptide leaf nodes of monophyletic group II comprise at least two domains characterized by an InterPro accession number selected from the group consisting of IPR024519, IPR008964, IPR013783, IPR038177 and IPR003535. According to these embodiments, the isolated insecticidal polypeptide clustering within said monophyletic group II comprises an amino acid sequence exhibiting at least 65% identity to a polypeptide comprising an amino acid sequence selected from the group consisting of SEQ ID NOs:433 (designated ICM149) and 487 (designated ICM149_H3).

According to certain exemplary embodiments, the insecticidal polypeptide leaf nodes of said monophyletic group II and the isolated insecticidal polypeptide clustering within same comprise the domains characterized by the InterPro accession numbers IPR024519, IPR008964, IPR013783, IPR038177 and IPR003535.

According to an aspect of the present invention, there is provided an isolated insecticidal polypeptide clustering within a monophyletic group III, the isolated insecticidal polypeptide is capable of killing or inhibiting the development of an insect pest, wherein the monophyletic group III comprises a plurality of insecticidal polypeptide leaf nodes comprising a leaf node having the amino acid sequence set forth in SEQ ID NO:470; and a leaf node having the amino acid sequence set forth in SEQ ID NO:491.

According to certain embodiments, the monophyletic group III further comprises at least one additional insecticidal polypeptide leaf node having an amino acid sequence selected from the group consisting of SEQ ID NOs:702-704, 772-774, and any combination thereof. According to some embodiments, the monophyletic group III further comprises insecticidal polypeptide leaf nodes having the amino acid sequences set forth in SEQ ID NOs:702-704, and 772-774.

According to certain embodiments, the insecticidal polypeptide leaf nodes of monophyletic group III comprise the domains characterized by InterPro accession numbers IPR036716 and IPR005639. According to these embodiments, the isolated insecticidal polypeptide clustering within said monophyletic group III comprises an amino acid sequence exhibiting at least 23% identity to a polypeptide comprising an amino acid sequence selected from the group consisting of SEQ ID NOs:470 (designated ICM495) and 491 (designated ICM495H4).

According to an aspect of the present invention, there is provided an isolated insecticidal polypeptide clustering within a monophyletic group IV, the isolated insecticidal polypeptide is capable of killing or inhibiting the development of an insect pest, wherein the monophyletic group IV comprises a plurality of insecticidal polypeptide leaf nodes comprising a leaf node having the amino acid sequence set forth in SEQ ID NO:425; a leaf node having the amino acid sequence set forth in SEQ ID NO:492, a leaf node having the amino acid sequence set forth in SEQ ID NO:493, a leaf node having the amino acid sequence set forth in SEQ ID NO:494, a leaf node having the amino acid sequence set forth in SEQ ID NO:495, and a leaf node having the amino acid sequence set forth in SEQ ID NO:496.

According to certain embodiments, the monophyletic group IV further comprises at least one additional insecticidal polypeptide leaf node having an amino acid sequence selected from the group consisting of SEQ ID NOs:775-777, and any combination thereof. According to some embodiments, the monophyletic group IV further comprises insecticidal polypeptide leaf nodes having the amino acid sequences set forth in SEQ ID NOs:775-777.

According to certain embodiments, the insecticidal polypeptide leaf nodes of monophyletic group IV comprise at least two domains characterized by an InterPro accession number selected from the group consisting of IPR003610, IPR013783, IPR036573, IPR014756, IPR004302, IPR036116, IPR003961. According to these embodiments, the isolated insecticidal polypeptide clustering within said monophyletic group IV comprises an amino acid sequence exhibiting at least 26% identity to a polypeptide comprising an amino acid sequence selected from the group consisting of SEQ ID NO:425 (designated ICM86); SEQ ID NO:492 (designated ICM86_H21); SEQ ID NO:493 (designated ICM86_H22); SEQ ID NO:494 (designated ICM86_H23); SEQ ID NO:495 (designated ICM86_H24); and SEQ ID NO:496 (designated ICM86_H27).

According to certain exemplary embodiments, the insecticidal polypeptide leaf nodes of said monophyletic group IV and the isolated insecticidal polypeptide clustering within same comprise the domains characterized by the InterPro accession numbers IPR003610, IPR013783, IPR036573, IPR014756, IPR004302, IPR036116, and IPR003961.

The present invention further discloses binary and ternary insecticidal systems comprising two polypeptides. The binary or ternary system is significantly more active in killing or inhibiting the development of an insect pest compared to the activity of each polypeptide alone. Each of the polypeptides forming the binary or ternary system may or may not exhibit insecticidal activity. The binary systems provided herein are based in part on the discovery of bacterial genes encoding polypeptides forming insecticidal complexes. Unexpectedly, the present invention now shows that orthologs of each subunit also form binary system having enhanced insecticidal activity. Furthermore, subunits of the binary insecticidal complex form two distinct monophyletic groups.

According to certain embodiments, the present invention discloses a monophyletic group of a binary insecticidal system subunit, comprising a plurality of polypeptide leaf nodes comprising a leaf node having the amino acid sequence set forth in SEQ ID NO:409 (ICM1), a leaf node having the amino acid sequence set forth in SEQ ID NO:418 (ICM73), a leaf node having the amino acid sequence set forth in SEQ ID NO:422 (ICM83), a leaf node having the amino acid sequence set forth in SEQ ID NO:423 (ICM84), a leaf node having the amino acid sequence set forth in SEQ ID NO:442 (ICM235), and a leaf node having the amino acid sequence set forth in SEQ ID NO:489 (ICM1_H1).

According to certain embodiments, the monophyletic group of a binary insecticidal system subunit further comprises at least one additional polypeptide leaf node having an amino acid sequence selected from the group consisting of SEQ ID NOs:504, 531-533, 591-597, 764-768 and any combination thereof. According to some embodiments, the monophyletic group of a binary insecticidal system subunit further comprises polypeptide leaf nodes having the amino acid sequences set forth in SEQ ID NOs:504, 531-533, 591-597, and 764-768.

According to certain embodiments, the plurality of leaf node polypeptides shares a domain characterized by InterPro accession number IPR036716. Hitherto known proteins showing insecticidal activity and comprising the domain characterized by an InterPro accession number IPR036716, an N-terminal helical bundle domain involved in membrane insertion and pore formation further comprise a beta-sheet central domain involved in receptor binding and a C-terminal beta-sandwich domain (IPR005638) that interacts with the N-terminal domain to form a channel. The present invention shows for the first time that polypeptides comprising only the IPR036716 domain have insecticidal activity.

According to certain embodiments, the present invention discloses a monophyletic group of a binary insecticidal system subunit, comprising a plurality of polypeptide leaf nodes comprising a leaf node having the amino acid sequence set forth in SEQ ID NO:410 (ICM2), a leaf node having the amino acid sequence set forth in SEQ ID NO:419 (ICM74), a leaf node having the amino acid sequence set forth in SEQ ID NO:421 (ICM82), a leaf node having the amino acid sequence set forth in SEQ ID NO:424 (ICM85), a leaf node having the amino acid sequence set forth in SEQ ID NO:443 (ICM236), and a leaf node having the amino acid sequence set forth in SEQ ID NO:490 (ICM2_H1).

According to certain embodiments, the monophyletic group of a binary insecticidal system subunit further comprises at least one additional polypeptide leaf node having an amino acid sequence selected from the group consisting of SEQ ID NOs: 505-507, 534-536, 598-602, 769-771 and any combination thereof. According to some embodiments, the monophyletic group of a binary insecticidal system subunit further comprises polypeptide leaf nodes having the amino acid sequences set forth in SEQ ID NOs: 505-507, 534-536, 598-602, and 769-771.

According to an aspect of the some embodiments of the present invention there is provided a binary insecticidal system comprising a first polypeptide comprising an amino acid sequence at least 70% identical to SEQ ID NO:409 (designated ICM1) and a second polypeptide comprising an amino acid sequence at least 70% identical to SEQ ID NO:410 (designated ICM2), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:409 and the second polypeptide comprising the amino acid sequence set forth in SEQ ID NO:410.

According to certain exemplary embodiments, the binary insecticidal system is active in killing or inhibiting an insect pest selected from the group consisting of BCW (Black cutworm); CEW (Corn earworm); CLW (Egyptian cotton leafworm); ECB (European corn borer); FAW (Fall armyworm); SBL (Soybean looper); CL (Cabbage looper); and any combination thereof.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:489 (designated ICM1_H1) and a second polypeptide comprising an amino acid sequence at least 70% identical to SEQ ID NO:490 (designated ICM2_H1), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:489 and the second polypeptide comprising the amino acid sequence set forth in SEQ ID NO:490.

According to certain exemplary embodiments, the binary insecticidal system is active in killing or inhibiting an insect pest selected from the group consisting of ECB (European corn borer), WCR (Western corn rootworm), and a combination thereof.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:418 (designated ICM73) and a second polypeptide comprising an amino acid sequence at least 70% identical to SEQ ID NO:419 (designated ICM74), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:418 and the second polypeptide comprising the amino acid sequence set forth in SEQ ID NO:419.

According to certain exemplary embodiments, the binary insecticidal system is active in killing or inhibiting an insect pest selected from the group consisting of BCW (Black cutworm); CLW (Egyptian cotton leafworm); FAW (Fall armyworm); and any combination thereof.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:421 (designated ICM82) and a second polypeptide comprising an amino acid sequence at least 70% identical to SEQ ID NO:422 (designated ICM83), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:421 and the second polypeptide comprising the amino acid sequence set forth in SEQ ID NO:422.

According to certain exemplary embodiments, the binary insecticidal system is active in killing or inhibiting an insect pest selected from the group consisting of BCW (Black cutworm); CLW (Egyptian cotton leafworm); FAW (Fall armyworm); and any combination thereof.

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 70% identical to SEQ ID NO:423 (designated ICM84), and a second polypeptide comprising an amino acid sequence at least 70% identical to SEQ ID NO:424 (designated ICM85), wherein insecticidal activity of killing or inhibiting the development of an insect pest of the binary system is significantly elevated compared to the insecticidal activity of each of the first and the second polypeptides alone. According to currently exemplary embodiments, the first polypeptide comprising the amino acid sequence set forth in SEQ ID NO:423 and the second polypeptide comprising the amino acid sequence set forth in SEQ ID NO:424.

According to certain exemplary embodiments, the binary insecticidal system is active in killing or inhibiting CLW (Egyptian cotton leafworm).

According to certain embodiments, each of the first and the second polypeptides has no detectable insecticidal activity individually.

According to an aspect of the some embodiments of the present invention there is provided a binary insecticidal system comprising a first polypeptide comprising an amino acid sequence at least 95% identical to SEQ ID NO:442 (designated ICM235) and a second polypeptide comprising an amino acid sequence at least 95% identical to SEQ ID NO:443 (designated ICM236), wherein each of the first and the second polypeptides has no detectable insecticidal activity and the binary system shows insecticidal activity of killing or inhibiting the development of an insect pest.

According to currently exemplary embodiments, the first polypeptide comprises the amino acid sequence set forth in SEQ ID NO:442 and the second polypeptide comprises the amino acid sequence set forth in SEQ ID NO:443.

According to certain exemplary embodiments, the binary insecticidal system is active in killing or inhibiting an insect pest selected from the group consisting of BCW (Black cutworm); CLW (Egyptian cotton leafworm); FAW (Fall armyworm); and any combination thereof.

The present invention further provides insecticidal systems comprising three polypeptides, wherein each of the polypeptides alone shows reduced or no detectable insecticidal activity compared to insecticidal activity of killing or inhibiting the development of an insect of the ternary combination.

According to an aspect of the some embodiments of the present invention there is provided a ternary insecticidal system comprising a first polypeptide comprising an amino acid sequence at least 70% identical to SEQ ID NO:462 (designated ICM457), a second polypeptide comprising an amino acid sequence at least 70% identical to SEQ ID NO:463 (designated ICM458), and a third polypeptide comprising an amino acid sequence at least 70% identical to SEQ ID NO:464 (designated ICM459), wherein insecticidal activity of killing or inhibiting the development of an insect pest of the ternary system is significantly elevated compared to the insecticidal activity of each of the first, the second and the third polypeptides alone. According to currently exemplary embodiments, the first polypeptide comprises the amino acid sequence set forth in SEQ ID NO:462, the second polypeptide comprises the amino acid sequence set forth in SEQ ID NO:463, and the third polypeptide comprises the amino acid sequence set forth in SEQ ID NO:464.

According to certain embodiments, each of the first and the second polypeptides has no detectable insecticidal activity individually.

According to an aspect of some embodiments of the present invention, there is provided a composition comprising at least one isolated polypeptide or at least one combination of the isolated polypeptides capable of killing or inhibiting the development of an insect pest, wherein the at least one polypeptide comprises an amino acid sequence at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs:440, 986, 1172-1173, 409-439, 441-503, 942-985, 987-1073, 1143-1171, and 1174-1211, fragments and variants thereof, and any combination thereof, for killing or inhibiting the development of an insect pest.

According to certain embodiments, the composition further comprises at least one agent selected from the group consisting of: a carrier, a stabilizer, a diluent, a surfactant, and a mineral.

According to some embodiments, the composition comprises a combination of at least two and no more than five polypeptides of the isolated polypeptides of some embodiments of the invention, for killing or inhibiting the development of an insect pest.

According to some embodiments of the invention, the composition comprises a proteinaceous matter having more than about 20%, e.g., more than about 25%, 30%, 35%, 40%, 50%, 55%, 60%, 65%, 70%, 75%, 80%, 85% of protein (weight/weight).

According to some embodiments of the invention, the composition further comprises an agricultural carrier.

According to an aspect of some embodiments of the present invention there is provided a nucleic acid construct comprising an isolated polynucleotide comprising a nucleic acid sequence encoding the polypeptide of some embodiments of the invention, further comprising at least one regulatory element for directing the expression of the polynucleotide within a host cell.

According to some embodiments, the regulatory element is a promoter operably linked to the isolated polynucleotide, wherein the promoter is capable of directing transcription of the nucleic acid sequence in a host cell. According to certain embodiments, the promoter is heterologous to the isolated polynucleotide.

According to some embodiments of the invention, the nucleic acid sequence is selected from the group consisting of SEQ ID NOs:32, 854, 1103-1104, 1-31, 33-408, 810-853, 855-941, 1074-1102, and 1105-1142.

According to an aspect of some embodiments of the present invention there is provided at least one genetically modified isolated host cell expressing at least one heterologous polypeptide, the heterologous polypeptide is the isolated polypeptide of some embodiments of the invention.

It should be noted that a genetically modified cell is a cell that has undergone manipulation with a recombinant agent, such as a vector, a primer, an agent for genome editing and the like.

According to some embodiments of the invention, the polypeptide is expressed by an endogenous promoter.

According to some embodiments of the invention, the polypeptide is expressed by a heterologous promoter.

According to some embodiments of the present invention the at least one isolated host cell has been transformed with the nucleic acid construct of some embodiments of the invention.

According to some embodiments of the invention, the cell is a bacteria cell.

According to some embodiments, there is provided a plurality of the isolated bacterial cells and compositions comprising same. The plurality of bacterial cells can be of the same species and/or strains or of a variety of species and/or strains.

According to some embodiments of the invention, the plurality of isolated bacterial cells comprises no more than 100 bacterial species and/or strains, e.g., no more than 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, or 3 bacterial species or strains.

According to certain embodiments, the plurality of isolated bacterial cells comprises from 10-50 bacterial species and/or strains. According to certain exemplary embodiments, the plurality of isolated bacterial cells comprises 20 bacterial species and/or strains.

According to some embodiments of the invention, the at least one bacterial cell is in a sporulated form.

According to an aspect of some embodiments of the present invention there is provided a lysate of the bacterial cell of some embodiments of the invention.

According to some embodiments of the invention, the lysate comprises proteins of bacterial cells of no more than one hundred species and/or strains, e.g., no more than 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, or 3 bacterial species or strains.

According to certain embodiments, the lysate comprises proteins of bacterial cells of 10-50 species and/or strains. According to certain exemplary embodiments, the lysate comprises proteins of bacterial cells of 20 species and/or strains.

According to some embodiments of the invention, the lysate comprises proteins of no more than 5 bacterial species and/or strains.

According to some embodiments of the invention, the lysate comprises a whole cell lysate of the bacteria.

According to some embodiments of the invention, the lysate comprises a soluble fraction of the bacterial cells.

According to some embodiments of the invention, the lysate comprises inclusion bodies of the bacterial cells.

According to some embodiments of the invention, the host cell is a plant cell.

According to an aspect of some embodiments of the present invention there is provided a plant transformed with the nucleic acid construct of some embodiments of the invention, or comprising the plant cell of some embodiments of the invention.

According to some embodiments of the invention, the cell is a yeast cell.

According to some embodiments of the invention, the cell is an insect cell.

According to an aspect of some embodiments of the present invention there is provided a composition comprising the nucleic acid construct of some embodiments of the invention.

According to an aspect of some embodiments of the present invention there is provided a composition comprising the isolated cell of some embodiments of the invention.

According to an aspect of some embodiments of the present invention there is provided a composition comprising the lysate of some embodiments of the invention.

According to some embodiments of the invention, the composition is formulated such that the insecticidal activity of killing or the inhibiting the development of an insect is affected by per os administration.

According to some embodiments of the invention, the composition of some embodiments of the invention further comprises at least one agent selected from the group consisting of: a carrier, a stabilizer, a diluent, a surfactant, a mineral and an adjuvant.

According to some embodiments of the invention, the carrier is an agricultural carrier.

According to an aspect of some embodiments of the present invention there is provided a composition comprising:

(a) a fermentation product of the bacterial cell of some embodiments of the invention, wherein the fermentation has an insecticidal activity; and (b) at least one of a carrier, a stabilizer, a diluent, a surfactant, a mineral or an adjuvant.

According to some embodiments of the invention, the composition is in a dehydrated form.

According to some embodiments of the invention, the composition is in lyophilized form.

According to some embodiments of the invention, the composition is comprised in a container.

According to some embodiments of the invention, the compositionis in a form selected from the group consisting of pressurized form, a pressurizable form, a dry form, a liquid form, and/or a sprayable form.

According to some embodiments of the invention, the composition comprises a plurality of at least two distinct polypeptides and no more than 20 polypeptides.

According to some embodiments of the invention, the composition comprises a plurality of polynucleotides encoding at least two distinct polypeptides and no more than 20 polypeptides.

According to some embodiments of the invention, the composition comprises a plurality of nucleic acid constructs encoding at least two distinct polypeptides and no more than 20 polypeptides.

According to some embodiments of the invention, the composition comprises a plurality of isolated cells expressing at least two distinct polypeptides and no more than 20 polypeptides.

According to some embodiments of the invention, the lysate is of a plurality of bacterial cells expressing at least two distinct polypeptides and no more than 20 polypeptides.

According to some embodiments of the invention, at least one of the at least two distinct polypeptides is capable of killing or inhibiting the development of an insect pest.

According to some embodiments of the invention, at least one of the at least two distinct polypeptides is not capable of killing or inhibiting the development of an insect pest.

According to an aspect of some embodiments of the present invention there is provided a kit comprising the composition of some embodiments of the invention, and instructions for using the kit for killing or inhibiting the development of an insect pest.

According to an aspect of some embodiments of the present invention there is provided a method of increasing a resistance of a plant to an insect pest, comprising expressing within at least one cell of the plant the isolated polypeptide of some embodiments of the invention, or transforming the plant with the nucleic acid construct of some embodiments of the invention.

According to an aspect of some embodiments of the present invention there is provided a method of increasing a resistance of a plant to an insect, comprising contacting the plant or a part thereof with the at least one host cell of some embodiments of the invention, the lysate of some embodiments of the invention, the isolated polypeptide of some embodiments of the invention, the nucleic acid construct of some embodiments of the invention, and/or the composition of some embodiments of the invention, thereby increasing the resistance of the plant to the insect.

As used herein and in the claims section below, the phrases "capable of killing or inhibiting the development of an insect pest" and "having insecticidal activity" are used herein interchangeably and refer to an effective amount of the agent of some embodiments of the invention (e.g., the polypeptide of some embodiments of the invention, the polynucleotide of some embodiments of the invention, the nucleic acid construct of some embodiments of the invention, the cell of some embodiments of the invention, the composition of some embodiment of the invention) which is capable of killing or inhibiting the development of at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 8%, at least about 85%, at least about 90%, at least about 95%, at least about 96%, at least about 9%, at least about 98%, at least about 99%, or 100% of a population of the insect as compared to the population of an insect of the same species not exposed to/being in contact with/consuming the effective amount of the agent when grown under the same (e.g., identical) growth conditions; and/or when compared to the initial population of the insect prior to being exposed to/contacted with/fed with the agent of some embodiments of the invention.

Methods of qualifying insecticidal activity of an agent are known in the art (e.g., MacIntosh, Susan C., et al. "Specificity and efficacy of purified Bacillus thuringiensis proteins against agronomically important insects." Journal of invertebrate pathology 56.2 (1990): 258-266; O'Callahan M., et al. Bioassay of bacterial entomopathogens against insect larvae. Lacey, Lawrence A., ed. Manual of techniques in invertebrate pathology. Academic Press, 2012. Chapter IV p:101-127; each of which is fully incorporated herein by reference with its entirety), and are further described and exemplified hereinbelow. In addition, $IC_{50}$ values can be determined to qualify effective concentration of the agent resulting in inhibiting growth and development of at least 50% of the insect population.

Following is a non-limiting description of dose response assay used for $IC_{50}$ determination of an agent (e.g., an isolated polypeptide or a bacterial lysate), which is in contact with the insect. Briefly, protein samples are applied topically on the insect artificial diet (e.g., 100 µl in each of a 96-well microtiter plate). The agent (e.g., the protein sample) is serially diluted with reduction of 50% in concentration at each step prior to applying to the wells, and negative and positive controls are prepared. A typical dilution series would be by two-fold, for instance: 1 mg/ml, 0.5 mg/ml, 0.25 mg/ml, 0.125 mg/ml, and 0.062 mg/ml. Typically, 15 µl of sample are applied to each well of the diet. After application, the plates are held for 30-45 minutes allowing absorption/drying of samples. Plates are then infested with the insect species of interest using e.g., a fine camel hair brush (e.g., when the lepidopteran insects are used) or by transferring a mass infest of an average 5 insects/well (e.g., in case the Western corn rootworm are used). Following infestation, the plates are sealed with a microtiter plate Mylar seal membrane which is then punctured above each well with a fine insect pin. The plates are then placed at the appropriate temperature incubator and held for 96 hours prior to scoring for response. Insect response can be graded as normal (no response, "0"), stunting (moderate reduction in insect mass compared to negative controls, "1"), severe stunting (less than 20% the size of negative controls, ("2"), or death ("3").

As used herein and in the claims section below, the phrases "inhibitory activity" and/or "inhibiting the development of an insect", which are interchangeably used herein, refer to an activity which results in reducing the size and/or mass (e.g., stunting) of the insect as compared to the size and/or mass of an insect of the same species in the absence of the effective amount of the agent under the same (e.g., identical) growth conditions; and/or when compared to the size and/or mass of the insect prior to being contacted with the agent of some embodiments of the invention.

It should be noted that inhibition of the development of the insect can be quantified by weighing the insect mass before and after being contacted with/exposed to/fed with the agent of some embodiments of the invention, and/or by measuring the size (e.g., length and/or width and/or height) of the insect before and after being contacted with/exposed to/fed with the agent of some embodiments of the invention, and/or by comparing the size and/or mass of the same species of insect when grown in the presence of the agent of some embodiments of the invention to the size and/or mass, respectively, of the same species of insect when grown in the absence of the agent of some embodiments of the invention under the same (e.g., identical) growth conditions.

According to some embodiments of the invention, the effective amount of the agent of some embodiments of the invention (e.g., the polypeptide of some embodiments of the invention, the polynucleotide of some embodiments of the invention, the nucleic acid construct of some embodiments of the invention, the cell of some embodiments of the invention, the composition of some embodiment of the invention) is an amount capable of inhibiting the development of the insect by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 9%, at least about 99%, or 100% as compared to the development of an insect of the same species in the absence of the effective amount of the agent under the same (e.g., identical) growth conditions; and/or as compared to the development of the insect prior to being contacted with the agent of some embodiments of the invention.

Insect pests include insects selected from the orders Lepidoptera, Coleoptera, Diptera, Hemiptera, Hymenoptera, Mallophaga, Homoptera, Orthroptera, Thysanoptera, Dermaptera, Isoptera, Anoplura, Siphonaptera, Trichoptera and the like.

According to some embodiments of the invention, the insect is from the order of Lepidoptera, Coleoptera or Hemiptera.

The order Lepidoptera includes several families such as Papilionidae, Pieridae, Lycaenidae, Nymphalidae, Danaidae, Satyridae, Hesperiidae, Sphingidae, Saturniidae, Geometridae, Arctiidae, Noctuidae, Lymantriidae, Sesiidae, and Tineidae.

Non-limiting examples of insects of the order Lepidoptera include, but are not limited to armyworms, cutworms, loopers, and heliothines in the Family Noctuidae, e.g., Fall armyworm (*Spodoptera frugiperda*), Beet armyworm (*Spodoptera exigua*), Black armyworm (*Spodoptera exempta*), Southern armyworm (*Spodoptera eridania*), bertha armyworm (*Mamestra configurata*), black cutworm (*Agrotis ipsilon*), cabbage looper (*Trichoplusia ni*), soybean looper (*Pseudoplusia includens*), velvetbean caterpillar (*Anticarsia gemmatalis*), green cloverworm (*Hypena scabra*), tobacco budworm (*Heliothis virescens*), granulate cutworm (*Agrotis subterranea*), armyworm (*Pseudaletia unipuncta*), western cutworm (*Agrotis orthogonia*); borers, casebearers, webworms, coneworms, cabbageworms and skeletonizers from the Family Pyralidae, e.g., European corn borer (*Ostrinia nubilalis*), navel orangeworm (*Amyelois transitella*), corn root webworm (*Crambus caliginosellus*), sod webworm (*Herpetogramma licarsisalis*), sunflower moth (*Homoeosoma electellum*), lesser cornstalk borer (*Elasmopalpus lignosellus*); leafrollers, budworms, seed worms, and fruit worms in the Family Tortricidae, e.g., codling moth (*Cydia pomonella*), grape berry moth (*Endopiza viteana*), oriental fruit moth (*Grapholita molesta*), sunflower bud moth (*Suleima helianthana*); and many other economically important Lepidoptera, e.g., diamondback moth (*Plutella xylostella*), pink bollworm (*Pectinophora gossypiella*), and gypsy moth (*Lymantria dispar*). Other insect pests of order Lepidoptera include, e.g., cotton leaf worm (*Alabama argillacea*), fruit tree leaf roller (*Archips argyrospila*), European leafroller (*Archips rosana*) and other *Archips* species, (*Chilo suppressalis*, Asiatic rice borer, or rice stem borer), rice leaf roller (*Cnaphalocrocis medinalis*), corn root webworm (*Crambus caliginosellus*), bluegrass webworm (*Crambus teterrellus*), southwestern corn borer (*Diatraea grandiosella*), surgarcane borer (*Diatraea saccharalis*), spiny bollworm (*Earias insulana*), spotted bollworm (*Earias vittella*), American bollworm (*Helicoverpa armigera*), corn earworm (*Helicoverpa zea*, also known as soybean podworm and cotton bollworm), tobacco budworm (*Heliothis virescens*), sod webworm (*Herpetogramma licarsisalis*), Western bean cutworm (*Striacosta albicosta*), European grape vine moth (*Lobesia botrana*), citrus leafminer (*Phyllocnistis citrella*), large white butterfly (*Pieris brassicae*), small white butterfly (*Pieris rapae*, also known as imported cabbageworm), beet armyworm (*Spodoptera exigua*), tobacco cutworm (*Spodoptera litura*, also known as cluster caterpillar), and tomato leafminer (*Tuta absoluta*).

According to some embodiments of the invention, the insect from the order Lepidoptera is selected from the group consisting of: Black cutworm (BCW, *Agrotis ipsilon*), Corn earworm (CEW, *Helicoverpa zea*), Egyptian cotton leafworm (CLW, *Spodoptera littoralis*), European corn borer (ECB, *Ostrinia nubilalis*), Fall armyworm (FAW, *Spodoptera frugiperda*), Soybean looper (SBL, *Chrysodeixis includens*), and Cabbage looper (CL, *Trichoplusia ni*).

The order Coleoptera includes the suborders Adephaga and *Polyphaga*. Suborder Adephaga includes the superfamilies Caraboidea and Gyrinoidea, while suborder *Polyphaga* includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrinidae. Superfamily Hydrophiloidea includes the family Hydrophilidae. Superfamily Staphylinoidea includes the families Silphidae and Staphylinidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae; Superfamily Chrysomeloidea includes the family Chrysomelidae. The genus *Diabrotica* and the species Western corn rootworm (*Diabrotica virgifera virgifera*) are included within the family Chrysomelidae.

According to some embodiments of the invention, the insect from the order Coleoptera is the Western corn rootworm (WCR, *Diabrotica virgifera virgifera*).

The order Hemiptera include, but is not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (onespotted stink bug); Graptostethus spp. (complex of seed bugs); *Leptoglossus corculus* Say (leaf-footed pine seed bug); *Lygus lineolaris* Palisot de Beauvois (tarnished plant bug); L. *Hesperus* Knight (Western tarnished plant bug); *L. pratensis* Linnaeus (common meadow bug); *L. rugulipennis* Poppius (European tarnished plant bug); Lygocoris *pabulinus* Linnaeus (common green capsid); *Nezara viridula* Linnaeus (southern green stink bug); *Oebalus pugnax Fabricius* (rice stink bug); *Oncopeltus fasciatus* Dallas (large milkweed bug); *Pseudatomoscelis seriatus* Reuter (cotton fleahopper); *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Adelphocoris rapidus* Say (rapid plant bug); Poecilocapsus *lineatus* Fabricius (four-lined plant bug); *Nysius ericae* Schilling (false chinch bug); *Nysius raphanus* Howard (false chinch bug); *Eurygaster* spp.; Coreidae spp.; Pyrrhocoridae spp.; Tinidae spp.; Blostomatidae spp.; Reduviidae spp.; Cimicidae spp; and Green Peach Aphids (*Myzus persicae*).

According to some embodiments of the invention, the insect from the order Hemiptera is the Southern green stink bug (STK, *Nezara viridula*).

According to some embodiments of the invention the insect is of the genera *Spodoptera, Helicoverpa, Chrysodeixis, Trichoplusia, Ostrinia* and *Agrotis*. Examples include but are not limited to the species *Spodoptera exigua, Spodoptera littoralis* and *Spodoptera frugiperda, Helicoverpa zea* and *Helicoverpa armigera, Chrysodeixis includens, Chrysodeixis celebensis, Chrysodeixis eriosoma, Chrysodeixis argitifera, Chrysodeixis acuta illuminata, Chrysodeixis minutus* and *Chrysodeixis chalcites, Trichoplusia ni, Ostrinia nubilalis* or *Agrotis ipsilon*.

According to some embodiments of the invention the insect is of the genus *Diabrotica*. Examples include, but are not limited to *Diabrotica speciosa, Diabrotica barberi, Diabrotica balteata, Diabrotica undecimpunctata*, and *Diabrotica virgifera*.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hipposcidae, Oestridae, Tachinidae, Anthomyiidae, Muscidae, Calliphoridae, and Sarcophagidae. Diptera are not included in the embodiments of this invention According to some embodiments of the invention the insect is of the genus *Nezara*. Examples include but are not limited to *Nezara viridula*.

As mentioned, the insects are pests of major crops, such as Maize, Sorghum, Wheat, Sunflower, Cotton, Rice, Soybean, Barley and Oil Seed Rape. Examples of insects for the various crops include, but are not limited to, insects of Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; *Diabrotica virgifera*, western corn rootworm; *Diabrotica longicornis barberi*, northern corn rootworm; *Diabrotica undecimpunctata howardi*, southern corn rootworm; *Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass *thrips; Solenopsis* milesta, thief ant; *Tetranychus urticae*, twospotted spider mite; insects of *Sorghum: Chilo* partellus, sorghum borer; *Spodoptera frugiperda*, fall armyworm; *Helicoverpa zea*, corn earworm; *Elasmopalpus lignosellus*, lesser cornstalk borer; *Feltia subterranea*, granulate cutworm; Phyllophaga *crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; *Blissus leucopterus leucopterus*, chinch bug; *Contarinia sorghicola*, sorghum midge; *Tetranychus cinnabarinus*, carmine spider mite; *Tetranychus urticae*, twospotted spider mite; insects of Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer; *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco *thrips*; Cephus cinctus, wheat stem sawfly; *Aceria tulipae*, wheat curl mite; insects of Sunflower: *Suleima helianthana*, sunflower bud moth; *Homoeosoma electellum*, sunflower moth; *zygogramma*

*exclamationis*, sunflower beetle; *Bothyrus gibbosus*, carrot beetle; *Neolasioptera murtfeldtiana*, sunflower seed midge; insects of Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion *thrips; Franklinkiella fusca*, tobacco *thrips; Tetranychus cinnabarinus*, carmine spider mite; *Tetranychus urticae*, twospotted spider mite; insects of Rice: *Diatraea saccharalis*, sugarcane borer; *Spodoptera frugiperda*, fall armyworm; *Helicoverpa zea*, corn earworm; *Colaspis brunnea*, grape *colaspis; Lissorhoptrus oryzophilus*, rice water weevil; *Sitophilus oryzae*, rice weevil; *Nephotettix nigropictus*, rice leafhopper; *Blissus leucopterus leucopterus*, chinch bug; *Acrosternum hilare*, green stink bug; insects of Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean *thrips; Thrips tabaci*, onion *thrips; Tetranychus turkestani*, strawberry spider mite; *Tetranychus urticae*, twospotted spider mite; insects of Barley: *Ostrinia nubilalis*, European corn borer; *Agrotis ipsilon*, black cutworm; *Schizaphis graminum*, greenbug; Bliss us *leucopterus leucopterus*, chinch bug; *Acrosternum hilare*, green stink bug; *Euschistus serous*, brown stink bug; *Delia platura*, seedcorn maggot; *Mayetiola destructor*, Hessian fly; *Petrobia latens*, brown wheat mite; insects of Oil Seed Rape: *Brevicoryne brassicae*, cabbage aphid; *Phyllotreta cruciferae*, Flea beetle; *Mamestra configurata*, Bertha armyworm; *Plutella xylostella*, Diamondback moth; *Delia* ssp., and Root maggots.

According to some embodiments of the invention, the insect is selected from the group consisting of: Beet Armyworm (BAW) (*Spodoptera exigua*) (the order of Lepidoptera), *Lygus* (*Lygus hesperus*) (the order Hemiptera), Cabbage Loopers (*Trichoplusia ni*) (the order Lepidoptera), Diamondback Moth (*Plutella xylostella*) (the order Lepidoptera), Fall armyworm (*Spodoptera frugiperda*) (the order Lepidoptera), Western corn rootworm (*Diabrotica virgifera virgifera*) (the order of Coleoptera), Green Peach Aphids (*Myzus persicae*) (the order of Hemiptera), and Soybean Looper (*Chrysodeixis includens*) (the order Lepidoptera).

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologues are evolutionary counterparts derived from a single ancestral gene in the last common ancestor of given two species (Koonin E V and Galperin M Y (Sequence—Evolution—Function: Computational Approaches in Comparative Genomics. Boston: Kluwer Academic; 2003. Chapter 2, Evolutionary Concept in Genetics and Genomics. Available from: ncbi.nlm.nih.gov/books/NBK20255) and therefore have great likelihood of having the same function.

Identification of homologous sequences in bacterial species involves in the first stage blasting of the sequence-of-interest against any sequence database, such as the publicly available NCBI database which may be found at: ncbi.nlm.nih.gov using local identity which is defined with a very permissive cutoff since it is only a filter for the second global alignment stage.

At the second stage, homologous sequences are defined based on global identity of at least 80% of the filtered results from the first stage to the sequence of interest. There are several algorithms for finding the optimal global alignment for protein or nucleotide sequences.

1. Between two proteins:

EMBOSS-6.0.1 Needleman-Wunsch algorithm with the following parameters: gapopen=8 gapextend=2

Hypertext Transfer Protocol://emboss. sourceforge.net/apps/cvs/emboss/apps/needle.html; A general method applicable to the search of similarities in the amino acid sequence of two proteins" Journal of Molecular Biology, 1970, pages 443-53, volume 48.

2. Between a nucleotide sequence to a protein sequence:

GenCore 6.0 Smith-Waterman algorithm with the following parameters: model=frame+_p2n.model mode=qglobal Hypertext Transfer Protocol://biocceleration.com/Products.html;

Homology (e.g., percent homology, sequence identity+sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 9%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration.com/Products.html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cutoff −60% Identity on a span of 60% of the sequences lengths because it is used only as a filter for the global alignment stage. In this specific embodiment (when the local identity is used), the default filtering of the Blast package is not utilized (by setting the parameter "−F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

Standard (Mandatory) qualifiers:

---

[-asequence] sequence filename and optional format, or reference (input USA)
[-bsequence] seqall Sequence(s) filename and optional format, or reference
(input USA)
-gapopen float [10.0 for any sequence]. The gap open penalty is the score
taken away when a gap is created. The best value depends on the choice of comparison
matrix. The default value assumes you are using the EBLOSUM62 matrix for protein
sequences, and the EDNAFULL matrix for nucleotide sequences. (Floating point number
from 1.0 to 100.0)
-gapextend float [0.5 for any sequence]. The gap extension, penalty is added
to the standard gap penalty for each base or residue in the gap. This is how long gaps are
penalized. Usually you will expect a few long gaps rather than many short gaps, so the -continued gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
[-outfile] align [*needle] Output alignment file name
Additional (Optional) qualifiers:
-datafile matrixf [EBLOSUM62 for protein, EDNAFULL for DNA], This is the scoring matrix file used when comparing sequences. By default, it is the file 'EBLOSUM62' (for proteins) or the file 'EDNAFULL' (for nucleic sequences). These files are found in the 'data' directory of the EMBOSS installation.

Advanced (Unprompted) qualifiers:

-[no]brief       boolean [Y] Brief identity and similarity
Associated qualifiers:
"-asequence" associated qualifiers -sbegin1       integer   Start of the sequence to be used
-send1         integer   End of the sequence to be used
-sreverse1     boolean   Reverse (if DNA)
-sask1         boolean   Ask for begin/end/reverse
-snucleotide1  boolean   Sequence is nucleotide
-sprotein1     boolean   Sequence is protein
-slower1       boolean   Make lower case
-supper1       boolean   Make upper case
-sformat1      string    Input sequence format
-sdbname1      string    Database name
-sid1          string    Entryname
-ufo1          string    UFO features
-fformat1      string    Features format
-fopenfile1    string    Features file name
"-bsequence" associated qualifiers -sbegin2       integer   Start of each sequence to be used
-send2         integer   End of each sequence to be used
-sreverse2     boolean   Reverse (if DNA)
-sask2         boolean   Ask for begin/end/reverse
-snucleotide2  boolean   Sequence is nucleotide
-sprotein2     boolean   Sequence is protein
-slower2       boolean   Make lower case
-supper2       boolean   Make upper case
-sformat2      string    Input sequence format
-sdbname2      string    Database name
-sid2          string    Entryname
-ufo2          string    UFO features
-fformat2      string    Features format
-fopenfile2    string    Features file name
"-outfile" associated qualifiers -aformat3      string    Alignment format
-aextension3   string    File name extension
-adirectory3   string    Output directory
-aname3        string    Base file name
-awidth3       integer   Alignment width
-aaccshow3     boolean   Show accession number in the header
-adesshow3     boolean   Show description in the header
-ausashow3     boolean   Show the full USA in the alignment
-aglobal3      boolean   Show the full sequence in alignment
General qualifiers:

-auto          boolean   Turn off prompts
-stdout        boolean   Write first file to standard output
-filter        boolean   Read first file from standard input, write
                         first file to standard output
-options       boolean   Prompt for standard and additional values
-debug         boolean   Write debug output to program.dbg
-verbose       boolean   Report some/full command line options
-help          boolean   Report command line options. More information on
                         associated and general qualifiers can be found with -help -verbose
-warning       boolean   Report warnings
-error         boolean   Report errors
-fatal         boolean   Report fatal errors
-die           boolean   Report dying program messages 2. Between a protein sequence and a nucleotide sequence (following the tblastn filter):

GenCore 6.0 OneModel application utilizing the Frame+ algorithm with the following parameters: model=frame+_p2n.model mode=qglobal-q=protein. sequence -db=nucleotide.sequence. The rest of the parameters are unchanged from the default options:

Usage:
om-model=<model_fname>[-q=]query [-db]database [options]
-model=<model_fname> Specifies the model that you want to run. All models supplied by Compugen are located in the directory $CGNROOT/models/.
Valid command line parameters:
-dev=<dev_name>Selects the device to be used by the application.
Valid devices are:
bic-Bioccelerator (valid for SW, XSW, FRAME_N2P, and FRAME_P2N models).
xlg-BioXL/G (valid for all models except XSW).
xlp-BioXL/P (valid for SW, FRAME+_N2P, and FRAME_P2N models).
xlh-BioXL/H (valid for SW, FRAME+_N2P, and FRAME_P2N models).
soft-Software device (for all models).
-q=<query>Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name>Chooses the database set. The database set can be a sequence file or a database reference. The database format is detected automatically. However, you may specify a format using -dfmt parameter.
-qacc Add this parameter to the command line if you specify query using accession numbers.
dacc Add this parameter to the command line if you specify a database using accession numbers.
-dfmt/-qfmt=<format_type>Chooses the database/query format type. Possible formats are:
fasta-fasta with seq type auto-detected.
fastap-fasta protein seq.
fastan-fasta nucleic seq.
gcg-gcg format, type is auto-detected.
gcg9seq-gcg9 format, type is auto-detected.
gcg9seqp-gcg9 format protein seq.
gcg9seqn-gcg9 format nucleic seq.
nbrf-nbrf seq, type is auto-detected.
nbrfp-nbrf protein seq.
nbrfn-nbrf nucleic seq.
embl-embl and swissprot format.
genbank-genbank format (nucleic).
blast-blast format.
nbrf_gcg-nbrf-gcg seq, type is auto-detected.
nbrf_gcgp-nbrf-gcg protein seq.
nbrf_gcgn-nbrf-gcg nucleic seq.
raw-raw ascii sequence, type is auto-detected.
rawp-raw ascii protein sequence.
rawn-raw ascii nucleic sequence.
pir-pir codata format, type is auto-detected.
profile-gcg profile (valid only for -qfmt in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
Valid for SW and XSW.
-dtrans Performs a translated search, relevant for a protein query against a DNA database. Each database entry is translated to six reading frames and a result is given for each frame.
Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
zscore.
escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS. Possible values are:
PFS-PFS text format
FASTA—FASTA text format
BLAST-BLAST text format
-nonorm Do not perform score normalization.
-norm=<norm_name> Specifies the normalization method. Valid options are:
log-logarithm normalization.
std-standard normalization.
stat-Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.
-xgapext=<n> The penalty for extending a gap when inserting a codon (triplet).
The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.

Note:"-batch" and "-wait" parameters are mutually exclusive.

-version Prints the software version number.
-help Displays this help message. To get more specific help type:
"om-model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix-BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

It should be noted that a modified bacterial isolate with the improved insecticidal activity can be obtained during the expansion of the bacterial isolate in culture, under conditions which allow evolvement of at least one bacterial mutant having the improved properties.

In addition, it is noted that a non-genetically modified organism is an organism not being subject to DNA recombinant techniques and/or to genome editing techniques.

The invention also encompasses fragments of the above described polypeptides and polypeptides having mutations, such as deletions, insertions or substitutions of one or more amino acids, either naturally occurring or man induced, either randomly or in a targeted fashion.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest, and/or to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure. For example (see U.S. Pat. No. 7,214,862), the standard deviation of codon usage (SDCU), a measure of codon usage bias, may be calculated by first finding the squared proportional deviation of usage of each codon of the native gene relative to that of highly expressed plant genes, followed by a calculation of the average squared deviation. The formula used is:

$$\sum_{n=1}^{N}[(X_n - Y_n)/Y_n]2/N$$

wherein Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

Alternative method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (www.kazusa.or.jp/codon/). The Codon Usage Database contains codon usage tables for a number of different species, with each codon usage Table having been statistically determined based on the data present in Genbank.

By using the tables described above to determine the most preferred or most favored codons for each amino acid in a particular species (for example, rice), a naturally-occurring nucleotide sequence encoding a protein of interest can be codon optimized for that particular plant species. This is affected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application Publication No. WO 93/07278.

Bacterial genes quite often possess multiple methionine initiation codons in proximity to the start of the open reading frame. Translation initiation at one or more of these start codons often leads to generation of a functional protein, and it is not always predetermined which of these codons are used naturally in the bacterium. These start codons can include ATG codons, but additional codons, such GTG, may be used, for example by *Bacillus* sp. as a start codon, and proteins that initiate translation at GTG codons contain a methionine at the first amino acid. Thus, it is understood that use of one of the alternate methionine codons may also lead to generation of proteins capable of conferring resistance to plants against insect pests. These proteins are encompassed within the scope of the present invention. It will be understood that, when expressed in plants, it will be necessary to alter the alternate start codon to ATG for proper translation. In addition, the translation initiator methionine of a polypeptide of the disclosure may be cleaved off post translationally. One skilled in the art understands that the N-terminal translation initiator methionine can be removed by methionine aminopeptidase in many cellular expression systems.

As is known to the skilled Artisan, the polynucleotide coding sequence can be modified to add a codon at the position following the methionine start codon to create a restriction enzyme site for recombinant cloning purposes and/or for expression purposes.

A "signal peptide" is an amino acid sequence which is translated in conjunction with a protein and directs the protein to the secretory system (Chrispeels, J. J., (1991) Ann. Rev. Plant Phys. Plant Mol. Biol. 42:21-53). A signal peptide may form part of the polypeptides of the invention or may be added as described hereinabove. In plants, the signal peptide (typically referred to as transit peptide) may preferably direct the protein to the apoplast or to cell compartments such as the chloroplast.

According to certain embodiments of the present invention, a signal peptide required for expression in specific bacterium or plant species needs to be added or replace the native signal peptide. It is to be explicitly understood that polynucleotides and polypeptides optimized for expression in plant or bacterial cells by modification of their native N-terminus are encompassed within the scope of the present invention, although the global identity of the modified polypeptide to its parent peptide may be less than 70%. A polypeptide that was modified by removal of a native signal peptide thereof is considered herein as a "fragment polypeptide" or a "derived polypeptide", which includes the amino acid sequence of the mature polypeptide, without the native signal peptide of either a curated or an isolated natural polypeptide. As used herein, the term "optimized polypeptide" refers to a polypeptide encoded by a polynucleotide modified for optimized expression in a desired organism.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed. A promoter can be an endogenous or a heterologous promoter with respect to the gene (polynucleotide) controlled thereby.

As used herein the phrase "heterologous promoter" refers to a promoter from a different species or from the same species but from a different gene locus as of the isolated polynucleotide sequence.

For example, when the isolated polynucleotide (e.g., derived from a bacterial cell) is expressed in a plant cell then the isolated bacterial polynucleotide is heterologous to the plant host cell.

Additionally or alternatively, when the isolated polynucleotide from a certain bacterial cell (a certain bacterial isolate) is expressed in another bacterial organism than the organism of the original bacterial isolate, then the isolated polynucleotide is heterologous to the bacterial host cell.

Additionally or alternatively, the isolated polynucleotide can be expressed under a different promoter than the original (native) promoter under which regulation the isolated polynucleotide is expressed in the original bacterial isolate cell. In this case the polynucleotide is heterologous to the promoter. The promoter can be from the same organism or from a different organism (e.g., *E. coli*, or *vibrio*).

According to some embodiments of the invention, the promoter is heterologous to the isolated polynucleotide and/or to the host cell.

According to some embodiments of the invention, the promoter is heterologous to the isolated polynucleotide.

According to some embodiments of the invention, the promoter is heterologous to the host cell.

Any suitable promoter sequence can be used by the nucleic acid construct of some embodiments of the invention. For example, for expression in a plant cell the promoter is a plant promoter, preferably a constitutive promoter, a tissue-specific, an abiotic stress-inducible promoter, or a chemical induced promoter. For expression in a bacterial cell the promoter is a bacterial promoter, preferably a constitutive promoter, a stage-specific promoter or an inducible promoter.

According to some embodiments of the invention, the promoter is a plant promoter, which is suitable for expression of the exogenous polynucleotide in a plant cell.

Suitable promoters for expression in planta include, but are not limited to, Wheat SPA promoter (SEQ ID NO:1247; Albani et al, 1997. Plant Cell, 9:171-184); wheat LMW [SEQ ID NO:1248 (longer LMW promoter) and SEQ ID NO:1249 (LMW promoter)]; HMW glutenin-1 [SEQ ID NO:1250; (Wheat HMW glutenin-1 longer promoter); and SEQ ID NO:1251 (Wheat HMW glutenin-1 Promoter); Thomas and Flavell, 1990. The Plant Cell 2:1171-1180; Furtado et al., 2009. Plant Biotechnology Journal 7:240-253]; wheat alpha, beta and gamma gliadins [e.g., SEQ ID NO:1252 (wheat alpha gliadin, B genome, promoter); SEQ ID NO:1253 (wheat gamma gliadin promoter); Rafalski J A et al. 1984. EMBO 3:1409-1415], wheat TdPR60 [SEQ ID NO:1254 (wheat TdPR60 longer promoter) or SEQ ID NO:1255 (wheat TdPR60 promoter); Kovalchuk et al., 2009. Plant Mol Biol 71:81-98], maize Ubl Promoter [cultivar Nongda 105 (SEQ ID NO:1256); GenBank: DQ141598.1; Taylor et al., 1993. Plant Cell Rep 12: 491-495; and cultivar B73 (SEQ ID NO:1257; Christensen, A H et al. 1992. Plant Mol. Biol. 18(4):675-689); rice actin 1 (SEQ ID NO:1258; Mc Elroy et al. 1990, The Plant Cell (2):163-171 rice GOS2 [SEQ ID NO:1259 (rice GOS2 longer promoter) and SEQ ID NO:1260 (rice GOS2 Promoter); De Pater et al. 1992. Plant J. 2: 837-44], *Arabidopsis* Phol [SEQ ID NO:1261 (*Arabidopsis* Phol Promoter); Hamburger et al., Plant Cell. 2002; 14: 889-902,], ExpansinB promoters, e.g., rice ExpB5 [SEQ ID NO:1262 (rice ExpB5 longer promoter) and SEQ ID NO:1263 (rice ExpB5 promoter)] and Barley ExpB1 [SEQ ID NO:1264 (barley ExpB1 Promoter); Won et al. Mol Cells. 2010. 30:369-76], barley SS2 (sucrose synthase 2; SEQ ID NO:1265; Guerin and Carbonero, 1997. Plant Physiology 114(1):55-62), and rice PGSa (SEQ ID NO:1266; U.S. Pat. No. 7,700,835; Nakase et al., 1996. Plant Mol Biol. 32:621-30).

Suitable constitutive promoters include, for example, CaMV 35S promoter [SEQ ID NO:1267 (CaMV 35S (pQXNc) Promoter); SEQ ID NO:1268 (PJJ 35S from Brachypodium); SEQ ID NO:1269 (CaMV 35S (OLD) Promoter; Odell et al., Nature 313:810-812, 1985)], *Arabidopsis* At6669 promoter [SEQ ID NO:1270 (*Arabidopsis* At6669 (OLD) Promoter; see PCT Publication No. WO04081173 or the new At6669 promoter (SEQ ID NO:1271 (*Arabidopsis* At6669 (NEW) Promoter)]; maize Ubl Promoter [cultivar Nongda 105 (SEQ ID NO:1256); and cultivar B73 (SEQ ID NO:1257)]; rice actin 1 (SEQ ID NO:1258); pEMU (Last et al., 1991. Theor. Appl. Genet. 81:581-588); CaMV 19S (Nilsson et al., 1997. Physiol. Plant 100:456-462); rice GOS2 [SEQ ID NO:1259 (rice GOS2 longer Promoter) and SEQ ID NO:1260 (rice GOS2 Promoter); RBCS promoter (SEQ ID NO:1272); Rice cyclophilin (Bucholz et al., 1994 Plant Mol Biol. 25(5):837-43); Maize H3 histone (Lepetit et al., 1992 Mol. Gen. Genet. 231: 276-285); Actin 2 (An et al., 1996. Plant J. 10(1); 107-121) and Synthetic Super MAS (Ni et al., 1995. The Plant Journal 7: 661-676). Other constitutive promoters include those in U.S. Pat. Nos. 5,659,026; 5,608,149; 5,608,144; 5,604,121; 5,569,597: 5,466,785; 5,399,680; 5,268,463; and 5,608,142.

Suitable tissue-specific promoters include, but are not limited to, leaf-specific promoters [e.g., AT5G06690 (Thioredoxin), high expression, SEQ ID NO:1273); AT5G61520 (AtSTP3, low expression, SEQ ID NO:1274, described in Buttner et al., 2000. Plant, Cell and Environment 23:175-184); or the promoters described in Yamamoto et al., 1997. Plant J. 12:255-265; Kwon et al., 1994. Plant Physiol. 105:357-67; Yamamoto et al., 1994. Plant Cell Physiol. 35:773-778; Gotor et al., 1993. Plant J. 3:509-18; Orozco et al., Plant Mol. Biol. 1993. 23:1129-1138; and Matsuoka et al., 1993. Proc. Natl. Acad. Sci. USA 90:9586-9590; as well as *Arabidopsis* STP3 (AT5G61520) promoter (Buttner et al., 2000. Plant, Cell and Environment 23:175-184]; seed-preferred promoters [e.g., Napin (originated from *Brassica napus* which is characterized by a seed specific promoter activity; Stuitje A. R. et. al. 2003. Plant Biotechnology Journal 1(4):301-309; SEQ ID NO:1275 (*Brassica napus* NAPIN Promoter) from seed specific genes (Simon, et al., 1985. Plant Mol. Biol. 5:191; Scofield, et al., 1987. J. Biol. Chem. 262:12202; Baszczynski, et al., 1990. Plant Mol. Biol. 14:633), rice PGSa (SEQ ID NO:1266; U.S. Pat. No. 7,700,835), early seed development *Arabidopsis* BAN (AT1G61720) (SEQ ID NO:1276, US 2009/0031450), late seed development Arabidopsis ABI3 (AT3G24650) (SEQ ID NO:1277 (Arabidopsis ABI3 (AT3G24650) longer Promoter) or SEQ ID NO:1278 (Arabidopsis ABI3 (AT3G24650) Promoter)) (Ng et al., 2004. Plant Molecular Biology 54: 25-38), Brazil Nut albumin (Pearson et al., 1992. Plant Mol. Biol. 18: 235-245), legumin (Ellis, et al. 1988. Plant Mol. Biol. 10: 203-214), Glutelin (rice) (Takaiwa et al., 1986. Mol. Gen. Genet. 208:15-22; Takaiwa et al., 1987. FEBS Letts. 221: 43-47), Zein (Matzke et al., 1990. Plant Mol Biol, (143):323-332), napA (Stalberg et al., 1996. Planta 199:515-519); Wheat SPA (SEQ ID NO:1247); sunflower oleosin (Cummins et al., 1992. Plant Mol. Biol. 19: 873-876); endosperm specific promoters [e.g., wheat LMW (SEQ ID NO:1248; Wheat LMW Longer Promoter), and SEQ ID NO:1249 (Wheat LMW Promoter)] and HMW glutenin-1 [(SEQ ID NO:1250 (Wheat HMW glutenin-1 longer Promoter); and SEQ ID NO:1251 (Wheat HMW glutenin-1 Promoter); Colot et al., Mol Gen Genet 216:81-90, 1989; Olin et al., NAR 17:461-2, 1989), wheat alpha, beta and gamma gliadins (SEQ ID NO:1252 (wheat alpha gliadin (B genome) promoter); SEQ ID NO:1253 (wheat gamma gliadin promoter); Barley ltrl promoter, barley B1, C, D hordein (Cho et al., Theor Appl Gen 98:1253-62, 1999; Muller et al., Plant J 4:343-55, 1993; Sorenson et al., Mol Gen Genet 250:750-60, 1996), Barley DOF (Mena et al., 1998. The Plant Journal 116(1):53-62), Biz2 (EP99106056.7), Barley SS2 (SEQ ID NO:1265), wheat Tarp60 (Kovalchuk et al., 2009. Plant Mol Biol 71:81-98), barley D-hordein (D-Hor) and B-hordein (B-Hor) (Agnelo F et al., 2009. Plant Biotech J 793):240-253)], Synthetic promoter (Vicente-Carbajosa et al., 1998. Plant J. 13: 629-640), rice prolamin NRP33, rice -globulin Glb-1 (Wu et al., 1998. Plant Cell Physiology 39(8) 885-889), rice alpha-globulin REB/OHP-1 (Nakase et al. 1997. Plant Mol. Biol. 33: 513-S22), rice ADP-glucose PP (Russell et al., Trans Res 6:157-68, 1997), maize ESR gene family (Opsahl-Ferstad et al., Plant J 12:235-46, 1997), sorgum gamma-kafirin (DeRose et al., PMB 32:1029-35, 1996)], embryo specific promoters [e.g., rice OSH1 (Sato et al., Proc. Natl. Acad. Sci. USA, 93: 8117-8122, 1996), KNOX (Postma-Haarsma et al., 1999. Plant Mol. Biol. 39:257-71), rice oleosin (Wu et al., 1998. J. Biochem., 123:386], and flower-specific promoters [e.g., AtPRP4, chalene synthase (chsA) (Van der Meer et al., 1990. Plant Mol. Biol. 15, 95-109), LAT52 (Twell et al., 1989. Mol. Gen Genet 217:240-245), Arabidopsis apetala-3 (Tilly et al., 1998. Development 125:1647-57), Arabidopsis APETALA 1 (AT1G69120, API) (SEQ ID NO:1279 (Arabidopsis (AT1G69120) APETALA 1)) (Hempel et al., 1997. Development 124:3845-3853)], and root promoters [e.g., the ROOTP promoter [SEQ ID NO:12801; rice ExpB5 [SEQ ID NO:1263 (rice ExpB5 Promoter); or SEQ ID NO:1262 (rice ExpB5 longer Promoter)] and barley ExpB1 promoters (SEQ ID NO:1264) (Won et al. 2010. Mol. Cells 30: 369-376); Arabidopsis ATTPS-CIN (AT3G25820) promoter (SEQ ID NO:1281; Chen et al., 2004. Plant Phys 135:1956-66); Arabidopsis Phol promoter (SEQ ID NO: 1261), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

According to some embodiments of the invention, the promoter originates from bacteria or from a bacteriophage, and is suitable for expression of the exogenous polynucleotide in a bacterial cell.

Non-limiting examples of promoter sequences which can be used for expression in a bacterial cell include T7 promoter, Tac promoter, lac promoter, araBAD promoter, lacUV5 promoter, tac (hybrid), trc (hybrid), trp, phoA, recA, proU, cst-1, tetA, cadA, nar, PL, cspA, sp6, T7-lac operator, T3-lac operator, T5-lac operator, T4 gene 32, nprM-lac operator, VHb, and protein A promoter.

According to some embodiments of the invention, the promoter is suitable for expression in an insect cell. Such promoters can originate from various viruses such as Baculovirus, or flies such as Drosophila.

Non-limiting examples of promoters which are suitable for expression in an insect cell include polyhedrin, p10, IE-0, PCNA, OplE2, OplE1, Metallothionein and Actin 5C promoters.

The term "'plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising Acacia spp., Acer spp., Actinidia spp., Aesculus spp., Agathis australis, Albizia amara, Alsophila tricolor, Andropogon spp., Arachis spp, Areca catechu, Astelia fragrans, Astragalus cicer, Baikiaea plurijuga, Betula spp., Brassica spp., Bruguiera gymnorrhiza, Burkea africana, Butea frondosa, Cadaba farinosa, Calliandra spp, Camellia sinensis, Canna indica, Capsicum spp., Cassia spp., Centroema pubescens, Chacoomeles spp., Cinnamomum cassia, Coffea arabica, Colophospermum mopane, Coronillia varia, Cotoneaster serotina, Crataegus spp., Cucumis spp., Cupressus spp., Cyathea dealbata, Cydonia oblonga, Cryptomeria japonica, Cymbopogon spp., Cynthea dealbata, Cydonia oblonga, Dalbergia monetaria, Davallia divaricata, Desmodium spp., Dicksonia squarosa, Dibeteropogon amplectens, Dioclea spp, Dolichos spp., Dorycnium rectum, Echinochloa pyramidalis, Ehraffia spp., Eleusine coracana, Eragrestis spp., Erythrina spp., Eucalypfus spp., Euclea schimperi, Eulalia villosa, Pagopyrum spp., Feijoa sellowlana, Fragaria spp., Flemingia spp, Freycinetia banksli, Geranium thunbergii, GinAgo biloba, Glycine javanica, Gliricidia spp, Gossypium hirsutum, Grevillea spp., Guibourtia coleosperma, Hedysarum spp., Hemafjhia altissima, Heteropogon contoffus, Hordeum vulgare, Hyparrhenia rufa, Hypericum erectum, Hypeffhelia dissolute, Indigo incamata, Iris spp., Leptarrhena pyrolifolia, Lespediza spp., Lettuca spp., Leucaena leucocephala, Loudetia simplex, Lotonus bainesli, Lotus spp., Macrotyloma axillare, Malus spp., Manihot esculenta, Medicago saliva, Metasequoia glyptostroboides, Musa sapientum, Nicotianum spp., Onobrychis spp., Ornithopus spp., Oryza spp., Peltophorum africanum, Pennisetum spp., Persea gratissima, Petunia spp., Phaseolus spp., Phoenix canariensis, Phormium cookianum, Photinia spp., Picea glauca, Pinus spp., Pisum sativam, Podocarpus totara, Pogonarthria fleckii, Pogonaffhria

*squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively, algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention, the plant is a host plant of the insect of some embodiments of the invention.

According to some embodiments of the invention, wherein when the insect is the Black cutworm (BCW) insect then the plant is from a plant family selected from the group consisting of: Malvaceae, Poaceae, Liliaceae, Apiaceae, Fabaceae, Solanaceae, Chenopodiaceae, Brassicaceae, Theaceae, Solanaceae, Asteraceae, Chenopodiaceae, Cucurbitaceae, Rubiaceae, Convolvulaceae, Cucurbitaceae, Asteraceae, Apiaceae, Rosaceae, Ginkgoaceae, Iridaceae, Fabaceae, Malvaceae, Asteraceae, Poaceae, Convolvulaceae, Chenopodiaceae, Euphorbiaceae, Lamiaceae, Musaceae, Solanaceae, Papaveraceae, Pedaliaceae, Lamiaceae, Vitaceae, and Zingiberaceae.

According to some embodiments of the invention, wherein when the insect is the CEW insect then the plant is from a plant family selected from the group consisting of: Malvaceae, Amaranthaceae, Brassicaceae, Solanaceae, Chenopodiaceae, Rutaceae, Cucurbitaceae, Rosaceae, Geraniaceae, Asteraceae, Malvaceae, Asteraceae, Convolvulaceae, Asteraceae, Lamiaceae, Caprifoliaceae, Solanaceae, Salicaceae, Solanaceae, Chenopodiaceae, Fabaceae, and Poaceae.

According to some embodiments of the invention, wherein when the insect is the Egyptian cotton leafworm (CLW) insect then the plant is from a plant family selected from the group consisting of: Malvaceae, Actinidiaceae, Liliaceae, Amaranthaceae, Ranunculaceae, Scrophulariaceae, Apiaceae, Chenopodiaceae, Brassicaceae, Araceae, Asteraceae, Theaceae, Cannaceae, Solanaceae, Casuarinaceae, Cucurbitaceae, Rutaceae, Rubiaceae, Convolvulaceae, Tiliaceae, Taxodiaceae, Caryophyllaceae, Myrtaceae, Euphorbiaceae, Moraceae, Rosaceae, Iridaceae, Convolvulaceae, Euphorbiaceae, Verbenaceae, Lamiaceae, Musaceae, Cactaceae, Lauraceae, Arecaceae, Piperaceae, Salicaceae, Portulacaceae, Myrtaceae, Punicaceae, Fagaceae, Brassicaceae, Euphorbiaceae, Pedaliaceae, Chenopodiaceae, Lamiaceae, Sterculiaceae, Poaceae, Verbenaceae, Fabaceae, Violaceae, and Vitaceae.

According to some embodiments of the invention, wherein when the insect is the European corn borer (ECB) insect then the plant is from a plant family selected from the group consisting of: Amaranthaceae, Asteraceae, Solanaceae, Fabaceae, Malvaceae, Cannabaceae, Rosaceae, Salicaceae, and Poaceae.

According to some embodiments of the invention, wherein when the insect is Fall armyworm (*Spodoptera frugiperda*) insect then the plant is from a plant family selected from the group consisting of: Amaranthaceae, Apiaceae, Apocynaceae, Asteraceae, Brassicaceae, Caryophyllaceae, Chenopodiaceae, Convolvulaceae, Cucurbitaceae, Cyperaceae, Euphorbiaceae, Fabaceae, Geraniaceae, Iridaceae, Juglandaceae, Liliaceae, Malvaceae, Musaceae, Platanaceae, Poaceae, Poaceae, Polygonaceae, Portulacaceae, Rosaceae, Rutaceae, Solanaceae, Ericaceae, Violaceae, Vitaceae, and Zingiberaceae.

According to some embodiments of the invention, wherein when the insect is the Soybean Looper (*Chrysodeixis includens*) insect then the plant is from a plant family selected from the group consisting of: Amaranthaceae, Apiaceae, Araceae, Araliaceae, Asteraceae, Begoniaceae, Brassicaceae, Caryophyllaceae, Chenopodiaceae, Convolvulaceae, Cucurbitaceae, Euphorbiaceae, Fabaceae, Geraniaceae, Gesneriaceae, Hydrangeaceae, Lamiaceae, Lauraceae, Liliaceae, Malvaceae, Passifloraceae, Piperaceae, Poaceae, Polygonaceae, Portulacaceae, Rubiaceae, and Solanaceae.

According to some embodiments of the invention, wherein when the insect is the Cabbage Looper (*Trichoplusia ni*) insect then the plant is from a plant family selected from the group consisting of: crucifers (e.g., broccoli, cabbage, cauliflower, Chinese cabbage, collards, kale, mustard, radish, rutabaga, turnip, and watercress), beet, cantaloupe, celery, cucumber, lima bean, lettuce, parsnip, pea, pepper, potato, snap bean, spinach, squash, sweet potato, tomato, watermelon, *chrysanthemum*, hollyhock, snapdragon, sweetpea, cotton, tobacco, *Chenopodium album, Lactuca* spp. (wild lettuce), *Taraxacum officinale* (dandelion), and *Rumex crispus* (curly dock).

According to some embodiments of the invention, wherein when the insect is Western corn rootworm (*Diabrotica virgifera virgifera*) insect then the plant is from a plant family selected from the group consisting of: Asteraceae, Cucurbitaceae, Fabaceae, and Poaceae.

According to some embodiments of the invention, wherein when the insect is the Southern green stink bug (STK) insect then the plant is from a plant family selected from the group consisting of: Malvaceae, Scrophulariaceae, Fabaceae, Chenopodiaceae, Brassicaceae, Solanaceae, Juglandaceae, Rutaceae, Cucurbitaceae, Malvaceae, Asteraceae, Poaceae, Convolvulaceae, Oleaceae, Caprifoliaceae, Proteaceae, Magnoliaceae, Euphorbiaceae, Brassicaceae, Passifloraceae, Scrophulariaceae, Lauraceae, Anacardiaceae, Euphorbiaceae, Rosaceae, Pedaliaceae, Asteraceae, and Sterculiaceae.

Non-limiting examples of host plants of the insects of some embodiments of the invention include:
1. Host plants for the Black cutworm (BCW, *Agrotis ipsilon*) as described in Table 1 below;
2. Host plants for the Corn earworm (CEW, *Helicoverpa zea*) as described in Table 2 below;
3. Host plants for the Egyptian cotton leafworm (CLW, *Spodoptera* littoalis) as described in Table 3 below;
4. Host plants for the European corn borer (ECB, *Ostrinia nubilalis*) as described in Table 4 below.

5. Host plants for the Fall armyworm (*Spodoptera frugiperda*) are described in Table 5 below;
6. Host plants for the Soybean Looper (*Chrysodeixis includens*) as described in Table 6 below;
7. Host plants for the Cabbage Loopers (*Trichoplusia ni*) as described in Table 7 hereinunder.
8. Host plants for the Western corn rootworm (*Diabrotica virgifera virgifera*) as described in Table 8 below;
9. Host plants for the Southern green stink bug (STK, *Nezara viridula*) as described in Table 9 below.

Thus, killing or inhibiting the growth of the insects of some embodiments of the invention will be highly beneficial for the plants hosting these insects, thus protecting, rescuing and/or treating the plants from the deleterious effects of the insects.

TABLE 1

Host Plants for Black Cutworm (BCW, *Agrotis ipsilon*)

| Plant name | Family |
| --- | --- |
| *Abelmoschus esculentus* (okra) | Malvaceae |
| *Agrostis* (bentgrasses) | Poaceae |
| *Allium cepa* (onion) | Liliaceae |
| *Apium graveolens* (celery) | Apiaceae |
| *Arachis hypogaea* (groundnut) | Fabaceae |
| *Asparagus officinalis* (asparagus) | Liliaceae |
| *Atropa belladonna* (deadly nightshade) | Solanaceae |
| *Avena sativa* (oats) | Poaceae |
| *Beta vulgaris* var. *saccharifera* (sugarbeet) | Chenopodiaceae |
| *Brassica napus* var. *napus* (rape) | Brassicaceae |
| *Brassica nigra* (black mustard) | Brassicaceae |
| *Brassica oleracea* (cabbages, cauliflowers) | Brassicaceae |
| *Brassica oleracea* var. *gongylodes* (kohlrabi) | Brassicaceae |
| *Brassica oleracea* var. *italica* (broccoli) | Brassicaceae |
| *Brassica rapa* subsp. *chinensis* (Chinese cabbage) | Brassicaceae |
| *Brassica rapa* subsp. *rapa* (turnip) | Brassicaceae |
| Brassicaceae (cruciferous crops) | Brassicaceae |
| *Camellia sinensis* (tea) | Theaceae |
| *Capsicum annuum* (bell pepper) | Solanaceae |
| *Carthamus tinctorius* (safflower) | Asteraceae |
| *Chenopodium quinoa* (quinoa) | Chenopodiaceae |
| *Cicer arietinum* (chickpea) | Fabaceae |
| *Citrullus lanatus* (watermelon) | Cucurbitaceae |
| *Citrus* | Rutaceae |
| *Citrus sinensis* (navel orange) | Rutaceae |
| *Coffea* (coffee) | Rubiaceae |
| *Convolvulus arvensis* (bindweed) | Convolvulaceae |
| *Cucumis sativus* (cucumber) | Cucurbitaceae |
| *Cucurbita pepo* (marrow) | Cucurbitaceae |
| *Cynara cardunculus* var. *scolymus* (globe artichoke) | Asteraceae |
| *Daucus carota* (carrot) | Apiaceae |
| *Fragaria* (strawberry) | Rosaceae |
| *Ginkgo biloba* (kew tree) | Ginkgoaceae |
| *Gladiolus hybrids* (sword lily) | Iridaceae |
| *Glycine max* (soyabean) | Fabaceae |
| *Gossypium* (cotton) | Malvaceae |
| *Helianthus annuus* (sunflower) | Asteraceae |
| *Hordeum vulgare* (barley) | Poaceae |
| *Ipomoea batatas* (sweet potato) | Convolvulaceae |
| *Kochia* | Chenopodiaceae |
| *Lactuca sativa* (lettuce) | Asteraceae |
| *Lens culinaris* subsp. *culinaris* (lentil) | Fabaceae |
| *Linum usitatissimum* (flax) | Linaceae |
| *Malus domestica* (apple) | Rosaceae |
| *Manihot esculenta* (cassava) | Euphorbiaceae |
| *Medicago sativa* (lucerne) | Fabaceae |
| *Mentha* (mints) | Lamiaceae |
| *Mentha piperita* (Peppermint) | Lamiaceae |
| *Mentha spicata* (Spear mint) | Lamiaceae |
| *Musa* (banana) | Musaceae |
| *Nicotiana tabacum* (tobacco) | Solanaceae |
| *Papaver somniferum* (Opium poppy) | Papaveraceae |
| *Parthenium argentatum* (Guayule) | Asteraceae |
| *Phaseolus* (beans) | Fabaceae |
| *Phaseolus vulgaris* (common bean) | Fabaceae |
| *Pisum sativum* (pea) | Fabaceae |

TABLE 1-continued

Host Plants for Black Cutworm (BCW, *Agrotis ipsilon*)

| Plant name | Family |
| --- | --- |
| *Prunus domestica* (plum) | Rosaceae |
| *Prunus persica* (peach) | Rosaceae |
| *Prunus salicina* (Japanese plum) | Rosaceae |
| *Pyrus communis* (European pear) | Rosaceae |
| *Raphanus sativus* (radish) | Brassicaceae |
| *Ricinus communis* (castor bean) | Euphorbiaceae |
| *Saccharum officinarum* (sugarcane) | Poaceae |
| *Sapium sebiferum* (Chinese tallow tree) | Euphorbiaceae |
| *Sesamum indicum* (sesame) | Pedaliaceae |
| *Solanum lycopersicum* (tomato) | Solanaceae |
| *Solanum melongena* (aubergine) | Solanaceae |
| *Solanum tuberosum* (potato) | Solanaceae |
| *Sorghum bicolor* (sorghum) | Poaceae |
| *Stachys arvensis* (staggerweed) | Lamiaceae |
| *Trifolium* (clovers) | Fabaceae |
| *Trifolium alexandrinum* (Berseem clover) | Fabaceae |
| *Trifolium repens* (white clover) | Fabaceae |
| *Triticum* (wheat) | Poaceae |
| *Vicia faba* (faba bean) | Fabaceae |
| *Vigna unguiculata* (cowpea) | Fabaceae |
| *Vitis* (grape) | Vitaceae |
| *Zea mays* (maize) | Poaceae |
| *Zingiber* (ginger) | Zingiberaceae |

TABLE 2

Host Plants for Corn Earworm (CEW, *Helicoverpa zea*)

| Plant name | Family |
| --- | --- |
| *Abelmoschus esculentus* (okra) | Malvaceae |
| *Abutilon theophrasti* (velvet leaf) | Malvaceae |
| *Amaranthus* (amaranth) | Amaranthaceae |
| *Arachis hypogaea* (groundnut) | Fabaceae |
| *Brassica oleracea* (cabbages, cauliflowers) | Brassicaceae |
| *Brassica oleracea* var. *botrytis* (cauliflower) | Brassicaceae |
| *Brassica oleracea* var. *capitata* (cabbage) | Brassicaceae |
| *Cajanus cajan* (pigeon pea) | Fabaceae |
| *Capsicum* (peppers) | Solanaceae |
| *Capsicum annuum* (bell pepper) | Solanaceae |
| *Chenopodium quinoa* (quinoa) | Chenopodiaceae |
| *Cicer arietinum* (chickpea) | Fabaceae |
| *Citrus* | Rutaceae |
| *Cucumis melo* (melon) | Cucurbitaceae |
| *Cucumis sativus* (cucumber) | Cucurbitaceae |
| *Fragaria* (strawberry) | Rosaceae |
| *Fragaria ananassa* (strawberry) | Rosaceae |
| *Geranium carolinianum* (Carolina geranium) | Geraniaceae |
| *Gerbera* (Barbeton daisy) | Asteraceae |
| *Glycine max* (soyabean) | Fabaceae |
| *Gossypium* (cotton) | Malvaceae |
| *Helianthus annuus* (sunflower) | Asteraceae |
| *Ipomoea purpurea* (tall morning glory) | Convolvulaceae |
| *Lactuca sativa* (lettuce) | Asteraceae |
| *Lamium amplexicaule* (henbit deadnettle) | Lamiaceae |
| *Lespedeza juncea* var. *sericea* (Sericea lespedeza) | Fabaceae |
| *Lonicera japonica* (Japanese honeysuckle) | Caprifoliaceae |
| *Medicago lupulina* (black medick) | Fabaceae |
| *Medicago sativa* (lucerne) | Fabaceae |
| *Nicotiana tabacum* (tobacco) | Solanaceae |
| *Panicum miliaceum* (millet) | Poaceae |
| *Phaseolus* (beans) | Fabaceae |
| *Phaseolus vulgaris* (common bean) | Fabaceae |
| *Salix* (willows) | Salicaceae |
| *Securigera varia* (crown vetch) | Fabaceae |
| *Solanum lycopersicum* (tomato) | Solanaceae |
| *Solanum melongena* (aubergine) | Solanaceae |
| *Sorghum bicolor* (sorghum) | Poaceae |
| *Spinacia oleracea* (spinach) | Chenopodiaceae |
| *Trifolium* (clovers) | Fabaceae |
| *Trifolium incarnatum* (Crimson clover) | Fabaceae |
| *Vicia sativa* (common vetch) | Fabaceae |
| *Vicia villosa* (hairy vetch) | Fabaceae |

TABLE 2-continued

Host Plants for Corn Earworm (CEW, *Helicoverpa zea*)

| Plant name | Family |
|---|---|
| *Vigna unguiculata* (cowpea) | Fabaceae |
| *Zea mays* (maize) | Poaceae |
| *Zea mays* subsp. *mays* (sweetcorn) | Poaceae |

TABLE 3

Host Plants for Egyptian Cotton Leafworm (CLW, *Spodoptera littoalis*)

| Plant name | Family |
|---|---|
| *Abelmoschus esculentus* (okra) | Malvaceae |
| *Acacia nilotica* (gum arabic tree) | Fabaceae |
| *Actinidia arguta* (tara vine) | Actinidiaceae |
| *Alcea rosea* (Hollyhock) | Malvaceae |
| *Allium cepa* (onion) | Liliaceae |
| *Allium fistulosum* (Welsh onion) | Liliaceae |
| *Amaranthus* (amaranth) | Amaranthaceae |
| *Anemone* (windflower) | Ranunculaceae |
| *Antirrhinum majus* (snapdragon) | Scrophulariaceae |
| *Apium graveolens* (celery) | Apiaceae |
| *Arachis hypogaea* (groundnut) | Fabaceae |
| *Asparagus officinalis* (asparagus) | Liliaceae |
| *Beta vulgaris* (beetroot) | Chenopodiaceae |
| *Beta vulgaris* var. *saccharifera* (sugarbeet) | Chenopodiaceae |
| *Brassica oleracea* (cabbages, cauliflowers) | Brassicaceae |
| *Brassica oleracea* var. *capitata* (cabbage) | Brassicaceae |
| *Brassica rapa* subsp. *chinensis* (Chinese cabbage) | Brassicaceae |
| *Brassica rapa* subsp. *pekinensis* | Brassicaceae |
| Brassicaceae (cruciferous crops) | Brassicaceae |
| *Caladium* | Araceae |
| *Callistephus chinensis* (China aster) | Asteraceae |
| *Camellia sinensis* (tea) | Theaceae |
| *Canna* | Cannaceae |
| *Capsicum* (peppers) | Solanaceae |
| *Capsicum annuum* (bell pepper) | Solanaceae |
| *Casuarina equisetifolia* (casuarina) | Casuarinaceae |
| *Chloris gayana* (rhodes grass) | Poaceae |
| *Chrysanthemum indicum* (chrysanthemum) | Asteraceae |
| *Citrullus lanatus* (watermelon) | Cucurbitaceae |
| *Citrus* | Rutaceae |
| *Citrus aurantium* (sour orange) | Rutaceae |
| *Coffea arabica* (arabica coffee) | Rubiaceae |
| *Convolvulus* (morning glory) | Convolvulaceae |
| *Corchorus capsularis* (white jute) | Tiliaceae |
| *Corchorus olitorius* (jute) | Tiliaceae |
| *Cryptomeria* | Taxodiaceae |
| *Cucurbita* (pumpkin) | Cucurbitaceae |
| *Cucurbita pepo* (marrow) | Cucurbitaceae |
| *Cynara cardunculus* var. *scolymus* (globe artichoke) | Asteraceae |
| *Dalbergia sissoo* | Fabaceae |
| *Datura* (thorn-apple) | Solanaceae |
| *Daucus carota* (carrot) | Apiaceae |
| *Dianthus barbatus* (sweet williams) | Caryophyllaceae |
| *Dianthus caryophyllus* (carnation) | Caryophyllaceae |
| *Eucalyptus globulus* (Tasmanian blue gum) | Myrtaceae |
| Euphorbiaceae | Euphorbiaceae |
| Fabaceae (leguminous plants) | Fabaceae |
| *Ficus carica* (common fig) | Moraceae |
| *Fragaria vesca* (wild strawberry) | Rosaceae |
| *Gerbera* (Barbeton daisy) | Asteraceae |
| *Gladiolus hybrids* (sword lily) | Iridaceae |
| *Glycine max* (soyabean) | Fabaceae |
| *Gossypium* (cotton) | Malvaceae |
| *Gossypium barbadense* (Gallini cotton) | Malvaceae |
| *Guizotia abyssinica* (niger) | Asteraceae |
| *Helianthus annuus* (sunflower) | Asteraceae |
| *Helianthus tuberosus* (Jerusalem artichoke) | Asteraceae |
| *Hibiscus cannabinus* (kenaf) | Malvaceae |
| *Hibiscus mutabilis* (cottonrose) | Malvaceae |
| *Indigofera tinctoria* (true indigo) | Fabaceae |
| *Ipomoea batatas* (sweet potato) | Convolvulaceae |
| *Jatropha curcas* (jatropha) | Euphorbiaceae |

TABLE 3-continued

Host Plants for Egyptian Cotton Leafworm (CLW, *Spodoptera littoalis*)

| Plant name | Family |
|---|---|
| *Lactuca sativa* (lettuce) | Asteraceae |
| *Lantana* | Verbenaceae |
| *Luffa aegyptiaca* (loofah) | Cucurbitaceae |
| *Lycopersicon* | Solanaceae |
| *Malus sylvestris* (crab-apple tree) | Rosaceae |
| *Medicago sativa* (lucerne) | Fabaceae |
| *Melilotus* spp. | Fabaceae |
| *Mentha spicata* (Spear mint) | Lamiaceae |
| *Monstera deliciosa* (ceriman) | Araceae |
| *Morus* (mulberrytree) | Moraceae |
| *Musa* (banana) | Musaceae |
| *Musa* × *paradisiaca* (plantain) | Musaceae |
| *Nicandra physalodes* (apple of Peru) | Solanaceae |
| *Nicotiana tabacum* (tobacco) | Solanaceae |
| *Opuntia* (Pricklypear) | Cactaceae |
| *Oryza sativa* (rice) | Poaceae |
| *Persea americana* (avocado) | Lauraceae |
| *Phaseolus* (beans) | Fabaceae |
| *Phaseolus vulgaris* (common bean) | Fabaceae |
| *Phoenix dactylifera* (date-palm) | Arecaceae |
| *Piper* (pepper) | Piperaceae |
| *Pistia stratiotes* (water lettuce) | Araceae |
| *Pisum sativum* (pea) | Fabaceae |
| Poaceae (grasses) | Poaceae |
| *Polyphagous* (polyphagous) | |
| *Populus alba* (silver-leaf poplar) | Salicaceae |
| *Portulaca oleracea* (purslane) | Portulacaceae |
| *Prunus domestica* (plum) | Rosaceae |
| *Prunus salicina* (Japanese plum) | Rosaceae |
| *Psidium guajava* (guava) | Myrtaceae |
| *Punica granatum* (pomegranate) | Punicaceae |
| *Quercus petraea* (durmast oak) | Fagaceae |
| *Raphanus sativus* (radish) | Brassicaceae |
| *Ricinus communis* (castor bean) | Euphorbiaceae |
| *Rosa* (roses) | Rosaceae |
| *Saccharum officinarum* (sugarcane) | Poaceae |
| *Salvia officinalis* (common sage) | Lamiaceae |
| *Senecio* (Groundsel) | Asteraceae |
| *Sesamum indicum* (sesame) | Pedaliaceae |
| *Sesbania sesban* (sesban) | Fabaceae |
| *Solanum lycopersicum* (tomato) | Solanaceae |
| *Solanum melongena* (aubergine) | Solanaceae |
| *Solanum tuberosum* (potato) | Solanaceae |
| *Sorghum bicolor* (sorghum) | Poaceae |
| *Spinacia oleracea* (spinach) | Chenopodiaceae |
| *Tectona grandis* (teak) | Lamiaceae |
| *Theobroma cacao* (cocoa) | Sterculiaceae |
| *Trifolium* (clovers) | Fabaceae |
| *Trifolium alexandrinum* (Berseem clover) | Fabaceae |
| *Trifolium repens* (white clover) | Fabaceae |
| *Trifolium* spp. | Fabaceae |
| *Trigonella foenum-graecum* (fenugreek) | Fabaceae |
| *Triticum aestivum* (wheat) | Poaceae |
| *Verbena* (vervain) | Verbenaceae |
| *Vicia faba* (faba bean) | Fabaceae |
| *Vigna angularis* (adzuki bean) | Fabaceae |
| *Vigna mungo* (black gram) | Fabaceae |
| *Vigna radiata* (mung bean) | Fabaceae |
| *Vigna unguiculata* (cowpea) | Fabaceae |
| *Viola odorata* (English violet) | Violaceae |
| *Vitis vinifera* (grapevine) | Vitaceae |
| *Zea mays* (maize) | Poaceae |
| *Zinnia elegans* (zinnia) | Asteraceae |

TABLE 4

Host Plants for European Bom Borer (ECB, *Ostrinia nubilalis*)

| Plant name | Family |
|---|---|
| *Amaranthus* (amaranth) | Amaranthaceae |
| *Amaranthus retroflexus* (redroot pigweed) | Amaranthaceae |

TABLE 4-continued

Host Plants for European Born Borer (ECB, *Ostrinia nubilalis*)

| Plant name | Family |
| --- | --- |
| *Arctium minus* (common burdock) | Asteraceae |
| *Artemisia vulgaris* (mugwort) | Asteraceae |
| *Avena sativa* (oats) | Poaceae |
| *Capsicum* (peppers) | Solanaceae |
| *Capsicum annuum* (bell pepper) | Solanaceae |
| *Chrysanthemum* (daisy) | Asteraceae |
| *Cynara cardunculus* var. *scolymus* (globe artichoke) | Asteraceae |
| *Datura stramonium* (jimsonweed) | Solanaceae |
| *Echinochloa crus-galli* (barnyard grass) | Poaceae |
| *Glycine max* (soyabean) | Fabaceae |
| *Gossypium* (cotton) | Malvaceae |
| *Helianthus annuus* (sunflower) | Asteraceae |
| *Hordeum vulgare* (barley) | Poaceae |
| *Humulus lupulus* (hop) | Cannabaceae |
| *Malus domestica* (apple) | Rosaceae |
| *Pennisetum glaucum* (pearl millet) | Poaceae |
| *Phaseolus vulgaris* (common bean) | Fabaceae |
| *Poaceae* (grasses) | Poaceae |
| *Populus* (poplars) | Salicaceae |
| *Prunus persica* (peach) | Rosaceae |
| *Setaria italica* (foxtail millet) | Poaceae |
| *Solanum lycopersicum* (tomato) | Solanaceae |
| *Solanum tuberosum* (potato) | Solanaceae |
| *Sorghum bicolor* (sorghum) | Poaceae |
| *Sorghum halepense* (Johnson grass) | Poaceae |
| *Triticum aestivum* (wheat) | Poaceae |
| *Xanthium* (Cocklebur) | Asteraceae |
| *Zea mays* (maize) | Poaceae |
| *Zea mays* subsp. *mays* (sweetcorn) | Poaceae |

TABLE 5

Host Plants for Fall Armyworm (*Spodoptera frugiperda*)

| Plant name | Family |
| --- | --- |
| *Agrostis* (bentgrasses) | Poaceae |
| *Agrostis gigantea* (black bent) | Poaceae |
| *Alcea rosea* (Hollyhock) | Malvaceae |
| *Allium* | Liliaceae |
| *Allium cepa* (onion) | Liliaceae |
| *Amaranthus* (amaranth) | Amaranthaceae |
| *Andropogon virginicus* (broomsedge) | Poaceae |
| *Arachis hypogaea* (groundnut) | Fabaceae |
| *Asparagus officinalis* (asparagus) | Liliaceae |
| *Atropa belladonna* (deadly nightshade) | Solanaceae |
| *Avena sativa* (oats) | Poaceae |
| *Beta* | Chenopodiaceae |
| *Beta vulgaris* (beetroot) | Chenopodiaceae |
| *Beta vulgaris* var. *saccharifera* (sugarbeet) | Chenopodiaceae |
| *Brassica oleracea* (cabbages, cauliflowers) | Brassicaceae |
| *Brassica oleracea* var. *capitata* (cabbage) | Brassicaceae |
| *Brassica oleracea* var. *viridis* (collards) | Brassicaceae |
| *Brassica rapa* subsp. *oleifera* (turnip rape) | Brassicaceae |
| *Brassica rapa* subsp. *rapa* (turnip) | Brassicaceae |
| Brassicaceae (cruciferous crops) | Brassicaceae |
| *Capsicum* (peppers) | Solanaceae |
| *Capsicum annuum* (bell pepper) | Solanaceae |
| *Carex* (sedges) | Cyperaceae |
| *Carya* (hickories) | Juglandaceae |
| *Carya illinoinensis* (pecan) | Juglandaceae |
| *Cenchrus incertus* (Spiny burrgrass) | Poaceae |
| *Chenopodium album* (fat hen) | Chenopodiaceae |
| *Chenopodium quinoa* (quinoa) | Chenopodiaceae |
| *Chloris gayana* (rhodes grass) | Poaceae |
| *Chrysanthemum* (daisy) | Asteraceae |
| *Chrysanthemum morifolium* (chrysanthemum (florists')) | Asteraceae |
| *Cicer arietinum* (chickpea) | Fabaceae |
| *Citrullus lanatus* (watermelon) | Cucurbitaceae |
| *Citrus aurantium* (sour orange) | Rutaceae |
| *Citrus limon* (lemon) | Rutaceae |
| *Citrus reticulata* (mandarin) | Rutaceae |

TABLE 5-continued

Host Plants for Fall Armyworm (*Spodoptera frugiperda*)

| Plant name | Family |
| --- | --- |
| *Citrus sinensis* (navel orange) | Rutaceae |
| *Codiaeum variegatum* (croton) | Euphorbiaceae |
| *Convolvulus* (morning glory) | Convolvulaceae |
| *Cucumis sativus* (cucumber) | Cucurbitaceae |
| Cucurbitaceae (cuembits) | Cucurbitaceae |
| *Cyperus rotundus* (purple nutsedge) | Cyperaceae |
| *Dahlia pinnata* (garden dahlia) | Asteraceae |
| *Dianthus caryophyllus* (carnation) | Caryophyllaceae |
| *Echinochloa colona* (junglerice) | Poaceae |
| *Eryngium foetidum* | Apiaceae |
| *Fagopyrum esculentum* (buckwheat) | Polygonaceae |
| *Fragaria ananassa* (strawberry) | Rosaceae |
| *Fragaria chiloensis* (Chilean strawberry) | Rosaceae |
| *Gladiolus hybrids* (sword lily) | Iridaceae |
| *Glycine max* (soyabean) | Fabaceae |
| *Gossypium* (cotton) | Malvaceae |
| *Gossypium herbaceum* (short staple cotton) | Malvaceae |
| *Hevea brasiliensis* (rubber) | Euphorbiaceae |
| *Hibiscus cannabinus* (kenaf) | Malvaceae |
| *Hordeum vulgare* (barley) | Poaceae |
| *Ipomoea batatas* (sweet potato) | Convolvulaceae |
| *Ipomoea purpurea* (tall morning glory) | Convolvulaceae |
| *Lactuca sativa* (lettuce) | Asteraceae |
| *Malus domestica* (apple) | Rosaceae |
| *Medicago sativa* (lucerne) | Fabaceae |
| *Mucuna pruriens* (velvet bean) | Fabaceae |
| *Musa* (banana) | Musaceae |
| *Nicotiana tabacum* (tobacco) | Solanaceae |
| *Oryza sativa* (rice) | Poaceae |
| *Panicum miliaceum* (millet) | Poaceae |
| *Pelargonium* (pelargoniums) | Geraniaceae |
| *Pennisetum clandestinum* (kikuyu grass) | Poaceae |
| *Pennisetum glaucum* (pearl millet) | Poaceae |
| *Phaseolus* (beans) | Fabaceae |
| *Phaseolus vulgaris* (common bean) | Fabaceae |
| *Phleum pratense* (timothy grass) | Poaceae |
| *Pisum sativum* (pea) | Fabaceae |
| *Platanus occidentalis* (sycamore) | Platanaceae |
| *Plumeria* (frangipani) | Apocynaceae |
| *Poa annua* (annual meadowgrass) | Poaceae |
| *Poa pratensis* (smooth meadow-grass) | Poaceae |
| *Poaceae* (grasses) | Poaceae |
| *Portulaca oleracea* (purslane) | Portulacaceae |
| *Prunus persica* (peach) | Rosaceae |
| *Saccharum officinarum* (sugarcane) | Poaceae |
| *Secale cereale* (rye) | Poaceae |
| *Setaria italica* (foxtail millet) | Poaceae |
| *Setaria viridis* (green foxtail) | Poaceae |
| *Solanum* (nightshade) | Solanaceae |
| *Solanum lycopersicum* (tomato) | Solanaceae |
| *Solanum melongena* (aubergine) | Solanaceae |
| *Solanum tuberosum* (potato) | Solanaceae |
| *Sorghum bicolor* (sorghum) | Poaceae |
| *Sorghum caffrorum* | Poaceae |
| *Sorghum halepense* (Johnson grass) | Poaceae |
| *Sorghum sudanense* (Sudan grass) | Poaceae |
| *Spinacia oleracea* (spinach) | Chenopodiaceae |
| *Trifolium* (clovers) | Fabaceae |
| *Trifolium pratense* (purple clover) | Fabaceae |
| *Trifolium repens* (white clover) | Fabaceae |
| *Triticum aestivum* (wheat) | Poaceae |
| Turfgrasses | |
| *Urochloa* | Poaceae |
| *Vaccinium corymbosum* (blueberry) | Ericaceae |
| *Vigna unguiculata* (cowpea) | Fabaceae |
| *Viola* (violet) | Violaceae |
| *Vitis* (grape) | Vitaceae |
| *Vitis vinifera* (grapevine) | Vitaceae |
| *Xanthium strumarium* (common cocklebur) | Asteraceae |
| *Zea mays* (maize) | Poaceae |
| *Zea mays* subsp. *mays* (sweetcorn) | Poaceae |
| *Zea mays* subsp. *mexicana* (teosinte) | Poaceae |
| *Zingiber officinale* (ginger) | Zingiberaceae |

TABLE 6

Host Plants for Soybean Looper (SBL; *Chrysodeixis includens*)

| Plant name | Family |
| --- | --- |
| *Abelmoschus esculentus* (okra) | Malvaceae |
| *Allium sativum* (garlic) | Liliaceae |
| *Amaranthus* (amaranth) | Amaranthaceae |
| *Apium graveolens* (celery) | Apiaceae |
| *Arachis hypogaea* (groundnut) | Fabaceae |
| *Asparagus officinalis* (asparagus) | Liliaceae |
| *Aster* | Asteraceae |
| *Begonia* | Begoniaceae |
| *Brassica oleracea* (cabbages, cauliflowers) | Brassicaceae |
| *Brassica oleracea* var. *italica* (broccoli) | Brassicaceae |
| *Brassica oleracea* var. *viridis* (collards) | Brassicaceae |
| Brassicaceae (cruciferous crops) | Brassicaceae |
| *Cajanus cajan* (pigeon pea) | Fabaceae |
| *Calendula officinalis* (Pot marigold) | Asteraceae |
| *Capsicum annuum* (bell pepper) | Solanaceae |
| *Chenopodium album* (fat hen) | Chenopodiaceae |
| *Chrysanthemum* (daisy) | Asteraceae |
| *Citrullus lanatus* (watermelon) | Cucurbitaceae |
| *Cucumis sativus* (cucumber) | Cucurbitaceae |
| Cucurbitaceae (cucurbits) | Cucurbitaceae |
| *Cyamopsis tetragonoloba* (guar) | Fabaceae |
| *Cyphomandra betacea* (tree tomato) | Solanaceae |
| *Daucus carota* (carrot) | Apiaceae |
| *Dianthus caryophyllus* (carnation) | Caryophyllaceae |
| *Eryngium foetidum* | Apiaceae |
| *Eupatorium* | Asteraceae |
| *Euphorbia pulcherrima* (poinsettia) | Euphorbiaceae |
| *Geranium* (cranesbill) | Geraniaceae |
| *Gerbera jamesonii* (African daisy) | Asteraceae |
| *Glycine max* (soyabean) | Fabaceae |
| *Gossypium* (cotton) | Malvaceae |
| *Gossypium hirsutum* (Bourbon cotton) | Malvaceae |
| *Helianthus annuus* (sunflower) | Asteraceae |
| *Hydrangea* (hydrangeas) | Hydrangeaceae |
| *Ipomoea batatas* (sweet potato) | Convolvulaceae |
| *Ixora coccinea* (flame of woods) | Rubiaceae |
| *Lactuca sativa* (lettuce) | Asteraceae |
| *Lantana* | Verbenaceae |
| *Lepidium virginicum* (Virginian peppercress) | Brassicaceae |
| *Matthiola incana* (stock) | Brassicaceae |
| *Medicago sativa* (lucerne) | Fabaceae |
| *Mentha* (mints) | Lamiaceae |
| *Nasturtium officinale* (watercress) | Brassicaceae |
| *Nicotiana rustica* (wild tobacco) | Solanaceae |
| *Nicotiana tabacum* (tobacco) | Solanaceae |
| *Passiflora edulis* (passionfruit) | Passifloraceae |
| *Peperomia obtusifolia* (pepper-face) | Piperaceae |
| *Persea americana* (avocado) | Lauraceae |
| *Phaseolus* (beans) | Fabaceae |
| *Phaseolus lunatus* (lima bean) | Fabaceae |
| *Phaseolus vulgaris* (common bean) | Fabaceae |
| *Philodendron* | Araceae |
| *Physalis* (Groundcherry) | Solanaceae |
| *Pisum sativum* (pea) | Fabaceae |
| *Portulaca oleracea* (purslane) | Portulacaceae |
| *Pueraria montana* var. *lobata* (kudzu) | Fabaceae |
| *Rumex* (Dock) | Polygonaceae |
| *Saccharum officinarum* (sugarcane) | Poaceae |
| *Saintpaulia ionantha* (African violet) | Gesneriaceae |
| *Schefflera actinophylla* (umbrella tree) | Araliaceae |
| *Senecio bicolor* (dusty miller) | Asteraceae |
| *Solanum* (nightshade) | Solanaceae |
| *Solanum lycopersicum* (tomato) | Solanaceae |
| *Solanum melongena* (aubergine) | Solanaceae |
| *Solanum tuberosum* (potato) | Solanaceae |
| *Solidago* (Goldenrod) | Asteraceae |
| *Sonchus* (Sowthistle) | Asteraceae |
| *Sorghum bicolor* (sorghum) | Poaceae |
| *Verbena* (vervain) | Verbenaceae |
| *Vigna unguiculata* (cowpea) | Fabaceae |
| *Xanthium strumarium* (common cocklebur) | Asteraceae |
| *Zea mays* (maize) | Poaceae |

TABLE 7

Host plants for Cabbage Looper (*Trichoplusia ni*)

| Plant name | Family |
| --- | --- |
| *Apium graveolens* var. *dulce* | Umbelliferae |
| *Brassica napus* | Cruciferae |
| *Brassica oleracea* | Cruciferae |
| *Brassica oleracea* var. *acephala* | Cruciferae |
| *Cakile maritima* | Cruciferae |
| *Calendula* sp. | Asteraceae |
| *Chrysanthemum indicum* | Asteraceae |
| *Cucumis sativus* | Cucurbitaceae |
| *Encelia farinosa* A. Gray | Compositae |
| *Erodium cicutarium* | Geraniaceae |
| *Gossypium hirsutum* | Malvaceae |
| *Heliotropium curassavicum* | Boraginaceae |
| *Heterotheca subaxillaris* (Lam.) Britt. | Compositae |
| *Hieracium* spp. | Compositae |
| *Lactuca sativa* | Compositae |
| *Lactuca serriola* | Compositae |
| *Solanum lycopersicum* | Solanaceae |
| *Malva parviflora* | Malvaceae |
| *Medicago sativa* | Fabaceae |
| *Nicotiana glauca* | Solanaceae |
| *Pisum sativum* | Fabaceae |
| *Polanisia trachysperma* Torr. and A. Gray | Capparidaceae |
| *Portulaca oleraceae* L. | Portulacaceae |
| *Ricinus communis* | Euphorbiaceae |
| *Sisymbrium irio* | Cruciferae |
| *Solanum nigrum* | Solanaceae |
| *Solanum tuberosum* | Solanaceae |
| *Urtica* spp. | Urticaceae |

TABLE 8

Host Plants for Western Corn Rootworm (*Diabrotica virgifera virgifera*)

| Plant name | Family |
| --- | --- |
| *Cucurbita* (pumpkin) | Cucurbitaceae |
| *Cucurbita pepo* (marrow) | Cucurbitaceae |
| Cucurbitaceae (cucurbits) | Cucurbitaceae |
| Fabaceae (leguminous plants) | Fabaceae |
| *Glycine max* (soyabean) | Fabaceae |
| *Helianthus annuus* (sunflower) | Asteraceae |
| *Hordeum* (barleys) | Poaceae |
| *Panicum* (millets) | Poaceae |
| Poaceae (grasses) | Poaceae |
| Polyphagous (polyphagous) | |
| *Setaria* (Foxtailmillet) | Poaceae |
| *Tripsacum dactyl aides* (eastern gamagrass (USA)) | Poaceae |
| *Triticum* (wheat) | Poaceae |
| *Zea mays* (maize) | Poaceae |

TABLE 9

Host plant for Southern Green Stink Bug (STK, *Nezara viridula*)

| Plant name | Family |
| --- | --- |
| *Abelmoschus esculentus* (okra) | Malvaceae |
| *Antirrhinum* (snapdragon) | Scrophulariaceae |
| *Arachis hypogaea* (groundnut) | Fabaceae |
| *Beta vulgaris* var. *saccharifera* (sugarbeet) | Chenopodiaceae |
| *Brassica napus* var. *napus* (rape) | Brassicaceae |
| *Brassica nigra* (black mustard) | Brassicaceae |
| *Brassica rapa* subsp, *rapa* (turnip) | Brassicaceae |
| Brassicaceae (cruciferous crops) | Brassicaceae |
| *Cajanus cajan* (pigeon pea) | Fabaceae |
| *Capsicum annuum* (bell pepper) | Solanaceae |
| *Carya illinoinensis* (pecan) | Juglandaceae |
| *Citrus* | Rutaceae |
| Cucurbitaceae (cucurbits) | Cucurbitaceae |
| *Glycine max* (soyabean) | Fabaceae |

TABLE 9-continued

Host plant for Southern Green Stink Bug (STK, *Nezara viridula*)

| Plant name | Family |
| --- | --- |
| *Gossypium* (cotton) | Malvaceae |
| *Helianthus annuus* (sunflower) | Asteraceae |
| *Hibiscus* (rosemallows) | Malvaceae |
| *Hordeum vulgare* (barley) | Poaceae |
| *Ipomoea batatas* (sweet potato) | Convolvulaceae |
| *Lablab purpureus* (hyacinth bean) | Fabaceae |
| *Ligustrum japonicum* (Japanese privet) | Oleaceae |
| *Lonicera japonica* (Japanese honeysuckle) | Caprifoliaceae |
| *Macadamia integrifolia* (macadamia nut) | Proteaceae |
| *Magnolia liliiflora* (Lily magnolia) | Magnoliaceae |
| *Manihot esculenta* (cassava) | Euphorbiaceae |
| *Matthiola* | Brassicaceae |
| *Medicago sativa* (lucerne) | Fabaceae |
| *Nasturtium officinale* (watercress) | Brassicaceae |
| *Nicotiana tabacum* (tobacco) | Solanaceae |
| *Olea europaea* subsp. *europaea* (European olive) | Oleaceae |
| *Oryza sativa* (rice) | Poaceae |
| *Passiflora edulis* (passionfruit) | Passifloraceae |
| *Paulownia fortunei* (fortunes paulownia) | Scrophulariaceae |
| *Persea americana* (avocado) | Lauraceae |
| *Phaseolus* (beans) | Fabaceae |
| *Pistacia vera* (pistachio) | Anacardiaceae |
| *Prunus persica* (peach) | Rosaceae |
| *Prunus persica* var. *nucipersica* (nectarine) | Rosaceae |
| *Raphanus raphanistrum* (wild radish) | Brassicaceae |
| *Ricinus communis* (castor bean) | Euphorbiaceae |
| *Rubus idaeus* (raspberry) | Rosaceae |
| *Sesamum indicum* (sesame) | Pedaliaceae |
| *Sesbania sesban* (sesban) | Fabaceae |
| *Silybum marianum* (variegated thistle) | Asteraceae |
| *Solanum* (nightshade) | Solanaceae |
| *Solanum lycopersicum* (tomato) | Solanaceae |
| *Solanum melongena* (aubergine) | Solanaceae |
| *Sorghum bicolor* (sorghum) | Poaceae |
| *Syringa vulgaris* (lilac) | Oleaceae |
| *Theobroma cacao* (cocoa) | Sterculiaceae |
| *Trifolium pratense* (purple clover) | Fabaceae |
| *Triticum* (wheat) | Poaceae |
| *Vigna* (cowpea) | Fabaceae |
| *Vigna mungo* (black gram) | Fabaceae |
| *Vigna radiata* (mung bean) | Fabaceae |
| *Vigna umbellata* (Rice- bean) | Fabaceae |
| *Vigna unguiculata* (cowpea) | Fabaceae |
| *Zea mays* (maize) | Poaceae |

Insecticidal Compositions

The polypeptide of some embodiments of the invention, and/or the cell of the method of some embodiments of the invention, the lysate of some embodiments of the invention, the nucleic acid construct of some embodiments of the invention and/or the composition of some embodiments of the invention can be administered to the plant per se, or in a composition where it can be mixed with additional material(s).

Herein the term "active ingredient" refers to the polypeptide of some embodiments of the invention, and/or the cell of the method of some embodiments of the invention, the lysate of some embodiments of the invention, the nucleic acid construct of some embodiments of the invention and/or the composition of some embodiments of the invention accountable for the biological effect in inhibiting the activity and/or killing the insect of some embodiments of the invention.

According to some embodiments of the invention, polypeptide of some embodiments of the invention, and/or the cell of the method of some embodiments of the invention, the lysate of some embodiments of the invention, the nucleic acid construct of some embodiments of the invention and/or the composition of some embodiments of the invention is also capable of inhibiting a nematode.

According to some embodiments of the invention, the nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

It should be noted that the composition of some embodiments of the invention which includes the active ingredient, can further include a carrier (e.g., an inert carrier), and if necessary, also a surfactant and/or another auxiliary for formulation, such as an extender, by formulating the mixture into oil formulation, emulsifiable concentrate, flowable formulation, wettable powder, water dispersible granules, powder, granules, or the like. The formulation, which is used alone or by adding another inert component, can be used as a pesticide (e.g., against insects).

The composition of some embodiments of the invention may also contain further ingredients, such as stabilizers, antifoams, viscosity regulators, binders, tackifiers as well as fertilizers or other active ingredients in order to obtain special effects.

According to some embodiments of the invention, the composition further comprising at least one agent selected from the group consisting of: a carrier, a stabilizer, a diluent, a surfactant, a mineral and an adjuvant.

Suitable organic solvents include all polar and non-polar organic solvents usually employed for formulation purposes. Preferable the solvents are selected from ketones, methyl-isobutyl-ketone and cyclohexanone, amides, dimethyl formamide and alkanecarboxylic acid amides, N,N-dimethyl decaneamide and N,N-dimethyl octanamide, furthermore cyclic solvents, N-methyl-pyrrolidone, N-octylpyrrolidone, N-dodecyl-pyrrolidone, N-octyl-caprolactame, N-dodecyl-caprolactame and butyrolactone, furthermore strong polar solvents, dimethylsulfoxide, and aromatic hydrocarbons, xylol, Solvesso™ mineral oils, white spirit, petroleum, alkyl benzenes and spindle oil, also esters, propyleneglycol-monomethylether acetate, adipic acid dibutylester, acetic acid hexylester, acetic acid heptylester, citric acid tri-n-butylester and phthalic acid di-n-butylester, and also alkohols, benzyl alcohol and 1-methoxy-2-propanol.

According to some embodiments of the invention, a carrier is a natural or synthetic, organic or inorganic substance with which the active ingredients are mixed or combined for better applicability, in particular for application to plants or plant parts or seed. The carrier, which may be solid or liquid, is generally inert and should be suitable for use in agriculture.

Useful solid or liquid carriers include, for example, ammonium salts and natural rock dusts, such as kaolins, clays, talc, chalk, quartz, attapulgite, montmorillonite or diatomaceous earth, and synthetic rock dusts, such as finely divided silica, alumina and natural or synthetic silicates, resins, waxes, solid fertilizers, water, alcohols, especially butanol, organic solvents, mineral and vegetable oils, and derivatives thereof. Mixtures of such carriers can likewise be used.

Suitable solid filler and carrier include inorganic particles, carbonates, silicates, sulphates and oxides with an average particle size of between 0.005 and 20 µm, preferably of between 0.02 to 10 µm, for example ammonium sulphate, ammonium phosphate, urea, calcium carbonate, calcium sulphate, magnesium sulphate, magnesium oxide, aluminium oxide, silicium dioxide, so-called fine-particle silica, silica gels, natural or synthetic silicates, and alumosilicates and plant products like cereal flour, wood powder/sawdust and cellulose powder.

Useful solid carriers for granules include: for example, crushed and fractionated natural rocks such as calcite, marble, pumice, sepiolite, dolomite, and synthetic granules of inorganic and organic meals, and also granules of organic material such as sawdust, coconut shells, maize cobs and tobacco stalks.

Useful liquefied gaseous extenders or carriers are those liquids which are gaseous at standard temperature and under standard pressure, for example aerosol propellants such as halohydrocarbons, and also butune, propane, nitrogen and carbon dioxide.

In the formulations, it is possible to use tackifiers such as carboxymethylcellulose, and natural and synthetic polymers in the form of powders, granules or latices, such as gum arabic, polyvinyl alcohol and polyvinyl acetate, or else natural phospholipids, such as cephalins and lecithins, and synthetic phospholipids. Further additives may be mineral and vegetable oils.

If the extender used is water, it is also possible to employ, for example, organic solvents as auxiliary solvents. Useful liquid solvents are essentially: aromatics such as xylene, toluene or alkylnaphthalenes, chlorinated aromatics and chlorinated aliphatic hydrocarbons such as chlorobenzenes, chloroethylenes or dichloromethane, aliphatic hydrocarbons such as cyclohexane or paraffins, for example mineral oil fractions, mineral and vegetable oils, alcohols such as butanol or glycol and their ethers and esters, ketones such as acetone, methyl ethyl ketone, methyl isobutyl ketone or cyclohexanone, strongly polar solvents such as dimethylformamide and dimethyl sulphoxide, and also water.

Useful surfactants are emulsifiers and/or foam formers, dispersants or wetting agents having ionic or nonionic properties, or mixtures of these surfactants. Examples of these are salts of polyacrylic acid, salts of lignosulphonic acid, salts of phenolsulphonic acid or naphthalenesulphonic acid, polycondensates of ethylene oxide with fatty alcohols or with fatty acids or with fatty amines, substituted phenols (preferably alkylphenols or arylphenols), salts of sulphosuccinic esters, taurine derivatives (preferably alkyl taurates), phosphoric esters of polyethoxylated alcohols or phenols, fatty esters of polyols, and derivatives of the compounds containing sulphates, sulphonates and phosphates, for example alkylaryl polyglycol ethers, alkylsulphonates, alkylsulphates, arylsulphonates, protein hydrolysates, lignosulphite waste liquors and methylcellulose. The presence of a surfactant is necessary if one of the active ingredients and/or one of the inert carriers is insoluble in water and when application is effected in water. The proportion of surfactants is between 5 and 40 percent by weight of the composition of some embodiments of the invention.

Suitable surfactants (adjuvants, emulsifiers, dispersants, protective colloids, wetting agent and adhesive) include all common ionic and non-ionic substances, for example ethoxylated nonylphenols, polyalkyl glycolether of linear or branched alcohols, reaction products of alkyl phenols with ethylene oxide and/or propylene oxide, reaction products of fatty acid amines with ethylene oxide and/or propylene oxide, furthermore fatty acid esters, alkyl sulfonates, alkyl sulphates, alkyl ethersulphates, alkyl etherphosphates, arylsulphate, ethoxylated arylalkylphenols, tristyryl-phenolethoxylates, furthermore ethoxylated and propoxylated arylalkylphenols like sulphated or phosphated arylalkylphenolethoxylates and -ethoxy- and -propoxylates. Further examples are natural and synthetic, water soluble polymers, lignosulphonates, gelatine, gum arabic, phospholipides, starch, hydrophobic modified starch and cellulose derivatives, in particular cellulose ester and cellulose ether, further polyvinyl alcohol, polyvinyl acetate, polyvinyl pyrrolidone, polyacrylic acid, polymethacrylic acid and co-polymerisates of (meth)acrylic acid and (meth)acrylic acid esters, and further co-polymerisates of methacrylic acid and methacrylic acid esters which are neutralized with alkalimetal hydroxide and also condensation products of optionally substituted naphthalene sulfonic acid salts with formaldehyde.

It is possible to use dyes such as inorganic pigments, for example iron oxide, titanium oxide and Prussian Blue, and organic dyes such as alizarin dyes, azo dyes and metal phthalocyanine dyes, and trace nutrients such as salts of iron, manganese, boron, copper, cobalt, molybdenum and zinc.

Antifoams which may be present in the formulations include e.g. silicone emulsions, longchain alcohols, fatty acids and their salts as well as fluoroorganic substances and mixtures thereof.

Examples of thickeners are polysaccharides, xanthan gum or veegum, silicates, attapulgite, bentonite as well as fine-particle silica.

If appropriate, it is also possible for other additional components to be present, for example protective colloids, binders, adhesives, thickeners, thixotropic substances, penetrants, stabilizers, sequestrants, complexing agents. In general, the active ingredients can be combined with any solid or liquid additive commonly used for formulation purposes.

Solvents, carriers, surfactants, surface active compounds, etc., that are customarily employed in the art of formulation and can be suitably used within the present invention are disclosed, for example, in WO 96/10083.

The composition of some embodiments of the invention can be used as such or, depending on their particular physical and/or chemical properties, in the form of their formulations or the use forms prepared therefrom, such as aerosols, capsule suspensions, cold-fogging concentrates, warm-fogging concentrates, encapsulated granules, fine granules, flowable concentrates for the treatment of seed, ready-to-use solutions, dustable powders, emulsifiable concentrates, oil-in-water emulsions, water-in-oil emulsions, macrogranules, microgranules, oildispersible powders, oil-miscible flowable concentrates, oil-miscible liquids, gas (under pressure), gas generating product, foams, pastes, pesticide coated seed, suspension concentrates, suspoemulsion concentrates, soluble concentrates, suspensions, wettable powders, soluble powders, dusts and granules, water-soluble and water-dispersible granules or tablets, water-soluble and water-dispersible powders for the treatment of seed, wettable powders, natural products and synthetic substances impregnated with active ingredient, and also microencapsulations in polymeric substances and in coating materials for seed, and also ULV cold-fogging and warm-fogging formulations.

According to some embodiments of the invention, the composition of some embodiments of the invention is compatible with most other commonly used agricultural spray materials.

According to some embodiments of the invention, the composition of some embodiments of the invention may be administered as a dust, a suspension, a wettable powder or in any other material form suitable for agricultural application.

The composition of some embodiments of the invention, formulations and/or mixtures thereof generally contain between 0.05 and 99% by weight, 0.01 and 98% by weight, preferably between 0.1 and 95% by weight, more preferably between 0.5 and 90% of active ingredient, most preferably between 10 and 70% by weight. For special applications, e.g. for protection of wood and derived timber products the composition of some embodiments of the invention, formulations and/or mixtures thereof generally contain between 0.0001 and 95% by weight, preferably 0.001 to 60% by weight of active ingredient.

The contents of active ingredient in the application forms prepared from the formulations may vary in a broad range. The concentration of the active ingredients in the application forms is generally between 0.000001 to 95% by weight, preferably between 0.0001 and 2% by weight.

The composition of some embodiments of the invention may include not only formulations which are already ready for use and can be applied with a suitable apparatus to the plant or the seed, but also commercial concentrates which have to be diluted with water prior to use. Whereas commercial products are preferably formulated as concentrates, the end user will normally employ dilute formulations of substantially lower concentration, such as dilution in water and subsequent spraying of the resulting spray liquor, or application after dilution in oil.

The composition of some embodiments of the invention may also contain a further biologically active compound selected from fertilizers, micronutrient donors, plant growth preparations, herbicides, insecticides, fungicides, bactericides, nematicides, molluscicides, attractants, sterilants, acaricides, growth regulators, fertilizers, safeners, chemicals and/or semiochemicals and mixtures thereof, without loss of potency.

The composition may comprise from 0.1 to 99% by weight of the active ingredient; from 1 to 99.9% by weight of a solid or liquid adjuvant, and from 0 to 25% by weight of a surfactant.

The formulations mentioned can be prepared in a manner known per se, for example by mixing the active ingredients with at least one customary extender, solvent or diluent, adjuvant, emulsifier, dispersant, and/or binder or fixative, wetting agent, water repellent, if appropriate desiccants and UV stabilizers and, if appropriate, dyes and pigments, antifoams, preservatives, inorganic and organic thickeners, adhesives, gibberellins and also further processing auxiliaries and also water. Depending on the formulation type to be prepared further processing steps are necessary, e.g. wet grinding, dry grinding and granulation.

According to some embodiments of the invention, the treatment of the plants and plant parts with the composition of some embodiments of the invention, formulations and/or mixtures thereof is effected directly or by action on their surroundings, habitat or storage space by the customary treatment methods, for example by dipping, spraying, atomizing, irrigating, evaporating, dusting, fogging, broadcasting, foaming, painting, spreading-on, watering (drenching), drip irrigating and, in the case of propagation material, especially in the case of seeds, also by dry seed treatment, wet seed treatment, slurry treatment, incrustation, coating with one or more coats, etc. It is also possible to deploy the mixtures or compositions by the ultra-low volume method or to inject the mixtures or compositions preparation or the mixtures or compositions itself into the soil.

According to some embodiments of the invention, the composition of some embodiments of the invention may be applied to the crop area or plant to be treated, simultaneously or in succession, with further biologically active compounds. These compounds may be both fertilizers or micronutrient donors or other preparations that influence plant growth. They may also be selective herbicides, insecticides, fungicides, bactericides, nematicides, molluscicides or mixtures of several of these preparations, if desired together with further carriers, surfactants or application-promoting adjuvants customarily employed in the art of formulation. Suitable carriers and adjuvants can be solid or liquid and correspond to the substances ordinarily employed in formulation technology, natural or regenerated mineral substances, solvents, dispersants, wetting agents, tackifiers, binders or fertilizers. The formulations of the composition of some embodiments of the invention, and/or with other active ingredients, and, where appropriate, a solid or liquid adjuvant, are prepared in known manner, e.g., by homogeneously mixing and/or grinding the active ingredients with extenders, solvents, solid carriers, and in some cases surface-active compounds (surfactants).

According to some embodiments of the invention, the composition of some embodiments of the invention, comprised in a container.

According to some embodiments of the invention, the composition of some embodiments of the invention, being in a pressurized form, a pressurizable form, a dry form, a liquid form, and/or a sprayable form.

According to an aspect of some embodiments of the invention there is provided a kit comprising the composition of some embodiments of the invention, and instructions for use in killing or inhibiting the development of an insect.

Compositions of some embodiments of the invention may, if desired, be presented in a pack or dispenser device, such as a United States Environmental Protection Agency (U.S EPA) approved kit, which may contain one or more-unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the United States Environmental Protection Agency (U.S EPA) for application on plants (e.g., crops).

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants" tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, Eds. "Methods in Virology" 7 vols, Academic Press, New York 1967-1984; Hill, S.A. "Methods in Plant Virology", Blackwell, Oxford, 1984; Walkey, D.G.A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretches which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

The present invention also envisages expressing a plurality of exogenous polynucleotides in a single host plant to thereby achieve superior effect on insect inhibitory and/or killing activity.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence, which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants.

The regenerated transformed plants can then be cross-bred and resultant progeny selected for superior insect killing and/or inhibitory activity using conventional plant breeding techniques.

The nucleic acid construct of some embodiments of the invention can be expressed in a variety of host cells, such as plants (such as described above), bacterial cells, yeast, mammalian and insect cells.

According to some embodiments of the invention the nucleic acid construct is expressed in a bacterial cell for the production of the isolated polypeptide.

In addition to the elements already described, the expression vector of some embodiments of the invention may typically contain other specialized elements intended to increase the level of expression of cloned nucleic acids or to facilitate the identification of cells that carry the recombinant DNA.

It will be appreciated that the individual elements comprised in the expression vector can be arranged in a variety of configurations. For example, enhancer elements, promoters and the like, and even the polynucleotide sequence(s) encoding the polypeptide of some embodiments of the invention can be arranged in a "head-to-tail" configuration, may be present as an inverted complement, or in a complementary configuration, as an anti-parallel strand. While such variety of configuration is more likely to occur with non-coding elements of the expression vector, alternative configurations of the coding sequence within the expression vector are also envisioned.

Other than containing the necessary elements for the transcription and translation of the inserted coding sequence, the expression construct of some embodiments of the invention can also include sequences engineered to enhance stability, production, purification, yield or toxicity of the expressed peptide. For example, the expression of a fusion protein or a cleavable fusion protein comprising the polypeptide of some embodiments of the invention and a heterologous protein can be engineered. Such a fusion protein can be designed so that the fusion protein can be readily isolated by affinity chromatography; by immobilization on a column specific for the heterologous protein. Where a cleavage site is engineered between the polypeptide of some embodiments of the invention and the heterologous protein, the polypeptide of some embodiments of the invention can be released from the chromatographic column by treatment with an appropriate enzyme or agent that disrupts the cleavage site [e.g., see Booth et al. (1988) Immunol. Lett. 19:65-70; and Gardella et al., (1990) J. Biol. Chem. 265: 15854-15859].

As mentioned hereinabove, a variety of prokaryotic or eukaryotic cells can be used as host-expression systems to express the polypeptides of some embodiments of the invention. These include, but are not limited to, microorganisms, such as bacteria transformed with a recombinant bacteriophage DNA, plasmid DNA or cosmid DNA expression vector containing the coding sequence; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of some embodiments of the invention.

Examples of bacterial constructs include the pET series of *E. coli* expression vectors [Studier et al. (1990) Methods in Enzymol. 185:60-89).

In yeast, a number of vectors containing constitutive or inducible promoters can be used, as disclosed in U.S. Pat. No. 5,932,447. Alternatively, vectors can be used which promote integration of foreign DNA sequences into the yeast chromosome.

Other expression systems such as insects and mammalian host cell systems which are well known in the art and are further described hereinbelow can also be used by some embodiments of the invention.

Recovery of the recombinant polypeptide is effected following an appropriate time in culture. The phrase "recovering the recombinant polypeptide" refers to collecting the whole fermentation medium containing the polypeptide and need not imply additional steps of separation or purification. Notwithstanding the above, polypeptides of some embodiments of the invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

It should be noted that while some of the isolated polypeptides of the invention originate from bacterial cells, close orthologues of such polypeptide sequences can be identified by known bioinformatics methods in plants and can be further over-expressed in a plant by means of recombinant DNA techniques (e.g., as described above) and/or by genome editing (e.g., as described hereinunder).

According to some embodiments of the invention, overexpression of the polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and non-homologous end-joining (NFfEJ). NFfEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Since most genome-editing techniques can leave behind minimal traces of DNA alterations evident in a small number of nucleotides as compared to transgenic plants, crops created through gene editing could avoid the stringent regulation procedures commonly associated with genetically modified (GM) crop development. On the other hand, the traces of genome-edited techniques can be used for marker assisted selection (MAS) as is further described hereinunder. Target plants for the mutagenesis/genome editing methods according to the invention are any plants of interest including monocot or dicot plants.

Overexpression of a polypeptide by genome editing can be achieved by: (i) replacing an endogenous sequence encoding the polypeptide of interest or a regulatory sequence under the control which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Homology Directed Repair (HDR)

Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with the guide RNA [gRNA(s)] and Cas9 or Cas9 nickase. The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application. It is worth noting that the repair template must lack the Protospacer Adjacent Motif (PAM) sequence that is present in the genomic DNA, otherwise the repair template becomes a suitable target for Cas9 cleavage. For example, the PAM could be mutated such that it is no longer present, but the coding region of the gene is not affected (i.e. a silent mutation).

The efficiency of HDR is generally low (<10% of modified alleles) even in cells that express Cas9, gRNA and an exogenous repair template. For this reason, many laboratories are attempting to artificially enhance HDR by synchronizing the cells within the cell cycle stage when HDR is most active, or by chemically or genetically inhibiting genes involved in Non-Homologous End Joining (NHEJ). The low efficiency of HDR has several important practical implications. First, since the efficiency of Cas9 cleavage is relatively high and the efficiency of HDR is relatively low, a portion of the Cas9-induced double strand breaks (DSBs) will be repaired via NHEJ. In other words, the resulting population of cells will contain some combination of wild-type alleles, NHEJ-repaired alleles, and/or the desired HDR-edited allele. Therefore, it is important to confirm the presence of the desired edit experimentally, and if necessary, isolate clones containing the desired edit.

The HDR method was successfully used for targeting a specific modification in a coding sequence of a gene in plants (Budhagatapalli Nagaveni et al. 2015. "Targeted Modification of Gene Function Exploiting Homology-Directed Repair of TALEN-Mediated Double-Strand Breaks in Barley". G3 (Bethesda). 2015 September; 5(9): 1857-1863). Thus, the gfp-specific transcription activator-like effector nucleases were used along with a repair template that, via HDR, facilitates conversion of gfp into yfp, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. Scientific Reports 6, Article number: 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Activation of Target Genes Using CRISPR/Cas9

Many bacteria and archea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of Streptococcus pyogenes have shown that three components form an RNA/protein complex and together are sufficient for sequence-specific nuclease activity: the Cas9 nuclease, a crRNA containing 20 base pairs of homology to the target sequence, and a trans-activating crRNA (tracrRNA) (Jinek et al. Science (2012) 337: 816-821.). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to overexpress a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et al. which is fully incorporated herein by reference, describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20-nucleotide guide sequence of the single-guide RNA. An online CRISPR Design Tool can identify suitable target sites (http://tools(dot)genome-engineering(dot)org. Ran et al. Genome engineering using the CRISPR-Cas9 system nature protocols, VOL. 8 NO. 11, 2281-2308, 2013).

The CRISPR-Cas system was used for altering gene expression in plants as described in U.S. Patent Application Publication No. 20150067922 to Yang; Yinong et al., which is fully incorporated herein by reference. Thus, the engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in overexpression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks in genome editing. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al. Nature Methods (2012) 9:073-975; U.S. Pat. Nos. 8,304,222; 8,021,867; 8,119,381; 8,124,369; 8,129,134; 8,133,697; 8,143,015; 8,143,016; 8,148,098; or 8,163,514, the contents of each are incorporated herein by reference in their entirety. Alternatively, meganucleases with site specific cutting characteristics can be obtained using commercially available technologies e.g., Precision Biosciences' Directed Nuclease Editor™ genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., 2010; Kim et al., 1996; Li et al., 2011; Mahfouz et al., 2011; Miller et al., 2010).

Basically, ZFNs and TALENs restriction endonuclease technology utilizes a non-specific DNA cutting enzyme which is linked to a specific DNA binding domain (either a series of zinc finger domains or TALE repeats, respectively). Typically, a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012; Lee et al., 2010). In addition, when a fragment of DNA with homology to the targeted region is introduced in conjunction with the nuclease pair, the double-stranded break can be repaired via homology directed repair to generate specific modifications (Li et al., 2011; Miller et al., 2010; Urnov et al., 2005).

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, CA).

Method for designing and obtaining TALENs are described in e.g. Reyon et al. Nature Biotechnology 2012 May; 30(5):460-5; Miller et al. Nat Biotechnol. (2011) 29: 143-148; Cermak et al. Nucleic Acids Research (2011) 39 (12): e82 and Zhang et al. Nature Biotechnology (2011) 29 (2): 149-53. A recently developed web-based program named Mojo Hand was introduced by Mayo Clinic for designing TAL and TALEN constructs for genome editing applications (can be accessed through http://www(doOtal-endesign(dot)org). TALEN can also be designed and obtained commercially from e.g., Sangamo Biosciences™ (Richmond, CA).

The CRISPR/Cas system for genome editing contains two distinct components: a gRNA and an endonuclease Cas9.

The gRNA is typically a 20-nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break. Just as with ZFNs and TALENs, the double-stranded brakes produced by CRISPR/Cas can undergo homologous recombination or NHEJ.

The Cas9 nuclease has two functional domains: RuvC and HNH, each cutting a different DNA strand. When both of these domains are active, the Cas9 causes double strand breaks in the genomic DNA.

A significant advantage of CRISPR/Cas is that the high efficiency of this system coupled with the ability to easily create synthetic gRNAs enables multiple genes to be targeted simultaneously. In addition, the majority of cells carrying the mutation present biallelic mutations in the targeted genes.

However, apparent flexibility in the base-pairing interactions between the gRNA sequence and the genomic DNA target sequence allows imperfect matches to the target sequence to be cut by Cas9.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Thus, if specificity and reduced off-target effects are crucial, using the Cas9 nickase to create a double-nick by designing two gRNAs with target sequences in close proximity and on opposite strands of the genomic DNA would decrease off-target effect as either gRNA alone will result in nicks that will not change the genomic DNA.

Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription.

There are a number of publicly available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

"Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After electroporation and positive selection, homologously targeted clones are identified. Next, a second targeting vector that contains a region of homology with the desired mutation is electroporated into targeted clones, and negative selection is applied to remove the selection cassette and introduce the mutation. The final allele contains the desired mutation while eliminating unwanted exogenous sequences. [I don't understand the relevance of all this section]

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine.

Basically, the site-specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function.

Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell.

A number of transposon systems that are able to also transpose in cells e.g. vertebrates have been isolated or designed, such as Sleeping Beauty [Izsvák and Ivics Molecular Therapy (2004) 9, 147-156], piggyBac [Wilson et al. Molecular Therapy (2007) 15, 139-145], To12 [Kawakami et al., PNAS (2000) 97 (21): 11403-11408] or Frog Prince [Miskey et al. Nucleic Acids Res. Dec. 1, (2003) 31(23): 6873-6881]. Generally, DNA transposons translocate from one DNA site to another in a simple, cut-and-paste manner. Each of these elements has their own advantages, for example, Sleeping Beauty is particularly useful in region-specific mutagenesis, whereas To12 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore we will describe piggyBac (PB) as an example.

PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pretransposon state. After excision, PB can transpose into a new location or be permanently lost from the genome.

Typically, the transposase system offers an alternative means for the removal of selection cassettes after homologous recombination quite similar to the use of Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Genome editing using recombinant adeno-associated virus (rAAV) platform—this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis.

Sequence alterations in a specific gene can also be determined at the protein level using e.g. chromatography, electrophoretic methods, immunodetection assays such as ELISA and western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosyltransferase (ARPT).

As used herein the term "about" refers to ±10%.

The terms "comprise", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof. Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is understood that any Sequence Identification Number (SEQ ID NO) disclosed in the instant application can refer to either a DNA sequence or an RNA sequence, depending on the context where that SEQ ID NO is mentioned, even if that SEQ ID NO is expressed only in a DNA sequence format or an RNA sequence format. For example, SEQ ID NO:1247 is expressed in a DNA sequence format (e.g., reciting T for thymine), but it can refer to either a DNA sequence that corresponds to an MBI3 nucleic acid sequence, or the RNA sequence of an RNA molecule nucleic acid sequence. Similarly, though some sequences are expressed in an RNA sequence format (e.g., reciting U for uracil), depending on the actual type of molecule being described, it can refer to either the sequence of an RNA molecule comprising a dsRNA, or the sequence of a DNA molecule that corresponds to the RNA sequence shown. In any event, both DNA and RNA molecules having the sequences disclosed with any substitutes are envisioned.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non-limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A Laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Maryland (1989); Perbal, "A Practical Guide to Molecular Cloning", John Wiley and Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton and Lange, Norwalk, CT (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, CA (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1: Identifying Insecticidal Genes

The inventors of the present invention have identified 95 polynucleotides of bacterial origin that encode for insecticidal proteins active against lepidopteran, coleopteran and/or hemipteran insect pests when consumed orally. The insecticidal activity can be attained by supplementing the proteins onto the insect diet and/or by exogenously expressing the genes in planta, providing the plant with an insect resistance trait. Some of the identified genes were further introduced into *Arabidopsis*, tomato, Maize or Soybean plants to evaluate insect resistance of the genetically modified (GM) plants.

The polynucleotides and polypeptides of some embodiments of the invention having the insecticidal activity were discovered using a unified database of publicly available genomes and proprietary genomes and metagenomes, gene phylogeny, protein annotation, enzymatic function and pathways.

Genomics and Metagenomics Database Construction for Gene Discovery

Genomic profiling: Total DNA of single bacteria isolates or of a combination of unidentified bacteria isolated from soil (designated herein "environmental samples" was extracted and sequenced by a service lab (Omega Bioservices, GA USA). Raw read output underwent quality control (QC) followed by genome assembly using a proprietary pipeline. Publicly available National Center for Biotechnology Information (NCBI) deposits were further incorporated and the entire genome assembly dataset was further introduced into a gene prediction and annotation process, resulting with de novo and uniform gene identification and classification and with the establishment of a unified database.

Gene prediction: gene prediction was performed using Prokaryotic Dynamic Programming Genefinding Algorithm (Prodigal—BMC Bioinformatics. 2010 Mar. 8; 11(1):119).

Gene annotation: Predicted genes and proteins were annotated using BLAST™ search (blast. Ncbi.nlm.nih.gov/Blast.cgi) against NCBI nr (non-redundant protein sequence database) and by further analysis by InterPro (ebi.ac.uk/interpro/).

Identification of Insecticidal Genes from Proprietary Bacterial Isolates

The genes listed in Table 10 below were identified as having insecticidal function in either a standalone fashion or by forming a binary or tertiary insecticidal heterocomplex (composed of 2 or 3 different subunits) that may confer insect-resistance traits in planta. The inventors of the present invention identified in each of the genes the presence or absence of a native signal peptide preceding the sequence of the mature protein. In cases of presence of such a native signal peptide, an amino acid sequence was derived, which was identical to the curated sequence albeit excluding the native signal peptide. For example, SEQ ID NO:412 includes a native signal peptide (amino acids 1-33 of SEQ ID NO:412) and a mature amino acid sequence (amino acids 34-1242 of SEQ ID NO:412), and the "derived polypeptide" sequence (SEQ ID NO:1212) includes only amino acids 34-1212 of SEQ ID NO: 412, i.e., the mature protein.

The identified genes, their curated polynucleotide and polypeptide sequences and the sequences of the derived mature proteins are summarized in Table 10 hereinbelow (when the curated polypeptide does not include a native signal peptide, the mature protein is identical to the curated one).

TABLE 10

List of identified insecticidal genes from bacterial isolates or environmental samples

| Gene Name | Gene description | Bacterial species | Polyn. SEQ ID NO: | Polyp. SEQ ID NO: | Derived polypide SEQ ID NO: |
|---|---|---|---|---|---|
| ICM1 | JHE-like toxin PirB | *Alcaligenes* Sp. | 1 | 409 | NA |
| ICM2 | JHE-like toxin PirA | *Alcaligenes* Sp. | 2 | 410 | NA |
| ICM11 | Internalin | Environmental sample | 3 | 411 | NA |
| ICM15 | Outer membrane autotransporter barrel domain-containing protein | Environmental sample | 4 | 412 | 1212 |
| ICM23 | Type IV secretion protein Rhs | Environmental sample | 5 | 413 | NA |
| ICM49 | tps family activation/secretion protein | Environmental sample | 6 | 414 | 1213 |
| ICM57 | Toxin | Environmental sample | 7 | 415 | NA |
| ICM60 | E3 ubiquitin-protein ligase IpaH3 | Environmental sample | 8 | 416 | NA |
| ICM64 | Lectin-like protein BA14k precursor | Environmental sample | 9 | 417 | 1214 |
| ICM73 | Delta endotoxin, N-terminal domain protein | *Proteus penneri* | 10 | 418 | NA |
| ICM74 | Hypothetical protein | *Proteus penneri* | 11 | 419 | NA |
| ICM81 | Rhs-family protein | *Serratia marcescens* | 12 | 420 | NA |
| ICM82 | Hypothetical protein | *Shewanella violacea* | 13 | 421 | NA |
| ICM83 | Hypothetical protein | *Shewanella violacea* | 14 | 422 | NA |
| ICM84 | JHE-like toxin | *Sodalis* Sp. | 15 | 423 | NA |
| ICM85 | JHE-like toxin | *Sodalis* Sp. | 16 | 424 | NA |
| ICM86 | Fibronectin type III domain-containing protein | *Sodalis* Sp. | 17 | 425 | NA |
| ICM95 | Hypothetical protein | Environmental sample | 18 | 426 | 1215 |
| ICM99 | Type IV secretion protein Rhs | Environmental sample | 19 | 427 | NA |
| ICM111 | Hypothetical protein | Environmental sample | 20 | 428 | 1216 |
| ICM121 | Hypothetical protein | Environmental sample | 21 | 429 | NA |
| ICM125 | Hypothetical protein | Environmental sample | 22 | 430 | NA |
| ICM146 | TccC-like protein | Environmental sample | 23 | 431 | NA |
| ICM147 | Subtilisin family serine protease-like protein | Environmental sample | 24 | 432 | NA |
| ICM149 | Invasin | Environmental sample | 25 | 433 | 1217 |
| ICM166 | Serralysin precursor | Environmental sample | 26 | 434 | 1218 |
| ICM174 | Hypothetical protein | Environmental sample | 27 | 435 | NA |
| ICM191 | Metalloprotease | Environmental sample | 28 | 436 | NA |
| ICM192 | Hypothetical protein | Environmental sample | 29 | 437 | 1219 |
| ICM201 | Hypothetical protein | Environmental sample | 30 | 438 | NA |
| ICM207 | TcaA2-like protein | Environmental sample | 31 | 439 | NA |
| ICM208 | YD repeat-containing protein | Environmental sample | 32 | 440 | NA |
| ICM212 | Hypothetical protein | Environmental sample | 33 | 441 | 1220 |
| ICM235 | PirB similarities with putative juvenile hormone esterase | *Photorhabdus asymbiotica* | 34 | 442 | NA |
| ICM236 | Hypothetical protein | *Photorhabdus asymbiotica* | 35 | 443 | NA |
| ICM246 | Hypothetical protein | *Segetibacter koreensis* | 36 | 444 | NA |
| ICM275 | 1-phosphatidy-linositol phosphodiesterase | Environmental sample | 37 | 445 | NA |
| ICM307 | Hypothetical protein | *Acinetobacter* sp. | 38 | 446 | 1221 |
| ICM313 | Hypothetical protein | *Bacillus subtilis* | 39 | 447 | NA |
| ICM332 | Bacterial surface protein 26-residue | *Enterococcus* sp. | 40 | 448 | 1222 |
| ICM333 | WxL domain surface protein | *Enterococcus* sp. | 41 | 449 | 1223 |
| ICM349 | Hypothetical protein | *Providencia sneebia* | 42 | 450 | NA |
| ICM372 | TcaA2-like protein | *Pseudomonas* sp. | 43 | 451 | NA |
| ICM403 | Hypothetical protein | *Stenotrophomonas* sp. | 44 | 452 | NA |
| ICM417 | Hypothetical protein | Environmental sample | 45 | 453 | NA |
| ICM418 | Hypothetical protein | Environmental sample | 46 | 454 | NA |
| ICM419 | Hemolytic enterotoxin | Environmental sample | 47 | 455 | 1224 |
| ICM422 | Putative exported protein | Environmental sample | 48 | 456 | 1225 |

TABLE 10-continued

List of identified insecticidal genes from bacterial isolates or environmental samples

| Gene Name | Gene description | Bacterial species | Polyn. SEQ ID NO: | Polyp. SEQ ID NO: | Derived polypide SEQ ID NO: |
|---|---|---|---|---|---|
| ICM425 | Hypothetical protein | Environmental sample | 49 | 457 | NA |
| ICM430 | Glycoside hydrolase family 16 | Environmental sample | 50 | 458 | NA |
| ICM433 | Hypothetical protein | Environmental sample | 51 | 459 | 1226 |
| ICM434 | Hypothetical protein | Environmental sample | 52 | 460 | NA |
| ICM435 | Putative lipoprotein | Environmental sample | 53 | 461 | 1227 |
| ICM457 | Hemolysin BL lytic component L2 | *Bacillus thuringiensis* | 54 | 462 | 1228 |
| ICM458 | Hemolysin BL lytic component L1 | *Bacillus thuringiensis* | 55 | 463 | 1229 |
| ICM459 | Hemolysin BL-binding component B | *Bacillus thuringiensis* | 56 | 464 | 1230 |
| ICM466 | Toxin-like protein | *Paenibacillus polymyxa* | 57 | 465 | NA |
| ICM471 | YwqJ-like deaminase | *Photorhabdus luminescens* | 58 | 466 | NA |
| ICM483 | Putative surface protein | *Xenorhabdus nematophila* | 59 | 467 | NA |
| ICM484 | Putative nematicidal protein | *Xenorhabdus nematophila* | 60 | 468 | NA |
| ICM485 | Hemagglutinin | *Xenorhabdus nematophila* | 61 | 469 | 1231 |
| ICM495 | Delta endotoxin domain-containing protein | Environmental sample | 62 | 470 | NA |
| ICM503 | Internalin | Environmental sample | 63 | 471 | 1232 |
| ICM570 | Hypothetical protein | Environmental sample | 64 | 472 | NA |
| ICM571 | Hypothetical protein | Environmental sample | 65 | 473 | NA |
| ICM573 | Laccase domain protein slr1573 | Environmental sample | 66 | 474 | NA |
| ICM576 | Hypothetical protein | Environmental sample | 67 | 475 | NA |
| ICM579 | Hypothetical protein | Environmental sample | 68 | 476 | NA |
| ICM580 | Hypothetical protein | Environmental sample | 69 | 477 | NA |
| ICM601 | Exotoxin | Environmental sample | 70 | 478 | 1233 |
| ICM614 | LPXTG cell wall anchor domain protein | Environmental sample | 71 | 479 | 1234 |
| ICM621 | Bacteriophage protein | Environmental sample | 72 | 480 | NA |
| ICM623 | MucBP domain-containing cell surface protein | Environmental sample | 73 | 481 | 1235 |
| ICM147_H5 | Subtilisin family serine protease-like protein | *Providencia* sp. | 74 | 482 | NA |
| ICM147_H9 | Peptidase | *Metagenomics data* | 75 | 483 | 1236 |
| ICM147_H23 | Collagenase | *Chryseobacterium* sp. | 76 | 484 | 1237 |
| ICM147_H35 | Peptidase | *Chryseobacterium* sp. | 77 | 485 | 1238 |
| ICM147_H36 | Peptidase | *Chryseobacterium* sp. | 78 | 486 | 1239 |
| ICM149_H3 | Invasin | *Providencia* sp. | 79 | 487 | 1240 |
| ICM162_H6 | Hypothetical protein | Environmental sample | 80 | 488 | NA |
| ICM1_H1 | Putative delta endotoxin | *Yersinia* sp. | 81 | 489 | NA |
| ICM2_H1 | JHE-like toxin PirA | *Yersinia* sp. | 82 | 490 | NA |
| ICM495_H4 | Delta endotoxin domain protein | *Comamonas* sp. | 83 | 491 | 1241 |
| ICM86_H21 | Fibronectin type III domain-containing protein | Environmental sample | 84 | 492 | NA |
| ICM86_H22 | Hypothetical protein | Environmental sample | 85 | 493 | 1242 |
| ICM86_H23 | Chitin-binding protein | Environmental sample | 86 | 494 | NA |
| ICM86_H24 | Fibronectin type III domain-containing protein | *Pseudomonas* sp. | 87 | 495 | NA |
| ICM86_H27 | Fibronectin type III domain-containing protein | *Pantoea allii* | 88 | 496 | NA |
| POC1 | Hypothetical protein | *Arsenophonus nasoniae* | 89 | 497 | NA |
| POC99 | Putative autotransporter | *Yersinia pseudotuberculosis* | 90 | 498 | NA |
| POC64_H1 | Fibronectin | *Paenibacillus* sp. | 91 | 499 | 1243 |
| PUB28 | Hypothetical protein | *Bacillus thuringiensis* | 92 | 500 | NA |

TABLE 10-continued

List of identified insecticidal genes from bacterial isolates or environmental samples

| Gene Name | Gene description | Bacterial species | Polyn. SEQ ID NO: | Polyp. SEQ ID NO: | Derived polypide SEQ ID NO: |
|---|---|---|---|---|---|
| PUB81 | Protective antigen-like protein | Brevibacillus laterosporus | 93 | 501 | 1244 |
| PUB85 | Chitin-binding protein | Bacillus thuringiensis | 94 | 502 | 1245 |
| PUB103 | Sulfurtransferase | Paenibacillus popilliae | 95 | 503 | 1246 |

Table 10: "polyn." = polynucleotide; "polyp." = polypeptide; "derived polypeptide" = amino acid of the mature polypeptide without the native signal peptide of the curated polypeptide. "NA"—not applicable.

Example 2: Identification of Orthologous Sequences of Insecticidal Proteins Retaining Insecticidal Activity Orthologues and paralogues constitute two major types of homologues: The first evolved from a common ancestor by specialization, and the latter are related by duplication events. It is assumed that paralogues arising from ancient duplication events are likely to have diverged in function while true orthologues are more likely to retain identical function over evolutionary time. Orthologues of the discovered insecticidal genes are not only likely to be insecticidal by themselves but also may hold improved potency or target different insect spectra.

The search and identification of homologous genes involves the screening of sequence information available in proprietary and public databases, such as the GenBank, and the European Molecular Biology Laboratory Nucleic Acid Sequence Database (EMBL).

Polynucleotides and polypeptides with significant homology to the identified genes described in Table 10 (Example 1) were identified from the databases using BLAST' software with the Blastp and tBlastn algorithms as filters for the first stage, and the needle (EMBOSS package) or Frame+ algorithm alignment for the second stage. Local identity (BLAST' alignments) was defined with a very permissive cutoff −60% identity on a span of 60% of the sequences' lengths, because it is used only as a filter for the global alignment stage. The default filtering of the BLAST' package was not utilized (by setting the parameter "−F F").

In the second stage, homologs were defined based on a global identity of at least 70% to the core gene polypeptide sequence. Two distinct forms for finding the optimal global alignment for protein or nucleotide sequences were used in this application:

1. Between two proteins (following the BLASTP filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter): GenCore 6.0 OneModel application utilizing the Frame+ algorithm with the following parameters: model=frame+_p2n.model mode=qglobal—q=protein.sequence -db=nucleotide.sequence. The rest of the parameters are unchanged from the default options described hereinabove.

The query polypeptide sequences were the sequences listed in Table 10 (Example 1), and the identified orthologous and homologous sequences having at least 70% global sequence identity to the sequences are provided in Table 11, hereinbelow. The output of the functional genomics approach described herein is a set of genes highly predicted to improve insect control traits.

TABLE 11

Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICMO67 | Artificial Sequence | 96 | 504 | 409 | 98.8 | globlastp |
| ICMO79 | Artificial Sequence | 97 | 505 | 410 | 98.5 | globlastp |
| ICMO80 | Artificial Sequence | 98 | 506 | 410 | 97.7 | globlastp |
| ICMO78 | Artificial Sequence | 99 | 507 | 410 | 90.2 | globlastp |
| ICM11_H2 | *Lactococcus* Sp. | 100 | — | 411 | 83.89 | glotblastn |
| ICM503_H1 | *Lactococcus* Sp. | 101 | 508 | 411 | 70.9 | globlastp |
| ICM503_H2 | *Lactococcus* Sp. | 102 | 509 | 411 | 70.9 | globlastp |
| ICM15_H2 | *Advenella* Sp. | 103 | 510 | 412 | 81.6 | globlastp |
| ICM15_H3 | *Advenella* Sp. | 104 | 511 | 412 | 80.4 | globlastp |
| ICM23_H3 | *Enterobacter* Sp. | 105 | 512 | 413 | 90.5 | globlastp |
| ICM23_H10 | *Enterobacter* Sp. | 106 | 513 | 413 | 89.3 | globlastp |
| ICM23_H11 | *Enterobacter* Sp. | 107 | 514 | 413 | 88.8 | globlastp |
| ICM23_H12 | *Thauera* Sp. | 108 | 515 | 413 | 87.9 | globlastp |
| ICM23_H2 | *Thauera* Sp. | 109 | 516 | 413 | 82.3 | globlastp |
| ICM23_H13 | *Klebsiella* Sp. | 110 | 517 | 413 | 74.3 | globlastp |
| ICM23_H14 | *Pantoea* Sp. | 111 | 518 | 413 | 71.8 | globlastp |
| ICM23_H9 | *Pantoea* Sp. | 112 | 519 | 413 | 70.9 | globlastp |
| ICM49_H4 | environmental sample | 113 | 520 | 414 | 99.1 | globlastp |
| ICM49_H2 | *Pseudomonas* Sp. | 114 | 521 | 414 | 98.4 | globlastp |
| ICM49_H5 | environmental sample | 115 | 522 | 414 | 78.9 | globlastp |

TABLE 11-continued Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICM57_H2 | environmental sample | 116 | 523 | 415 | 86.3 | globlastp |
| ICM57_H3 | Pseudomonas Sp. | 117 | 524 | 415 | 85.8 | globlastp |
| ICM57_H4 | Pseudomonas Sp. | 118 | 525 | 415 | 76.3 | globlastp |
| ICM57_H5 | environmental sample | 119 | 526 | 415 | 75.9 | globlastp |
| ICM57_H6 | Pseudomonas Sp. | 120 | 527 | 415 | 73.5 | globlastp |
| ICM57_H7 | Pseudomonas Sp. | 121 | 528 | 415 | 72.4 | globlastp |
| ICM57_H8 | Pseudomonas Sp. | 122 | 529 | 415 | 71.3 | globlastp |
| ICM57_H9 | Pseudomonas Sp. | 123 | 530 | 415 | 70.6 | globlastp |
| ICM73_H1 | Proteus Sp. | 124 | 531 | 418 | 99.5 | globlastp |
| ICM73_H2 | Proteus Sp. | 125 | 532 | 418 | 96.8 | globlastp |
| ICM73_H3 | Klebsiella Sp. | 126 | 533 | 418 | 94.7 | globlastp |
| ICM74_H1 | Proteus Sp. | 127 | 534 | 419 | 99 | globlastp |
| ICM74_H2 | Klebsiella Sp. | 128 | 535 | 419 | 96 | globlastp |
| ICM74_H3 | Proteus Sp. | 129 | 536 | 419 | 96 | globlastp |
| ICM81_H3 | Serratia Sp. | 130 | 537 | 420 | 89.5 | globlastp |
| ICM81_H4 | Serratia Sp. | 131 | 538 | 420 | 80.3 | globlastp |
| ICM99_H3 | environmental sample | 132 | 539 | 427 | 85.5 | globlastp |
| ICM111_H1 | environmental sample | 133 | 540 | 428 | 76.3 | globlastp |
| ICM111_H2 | Enterococcus Sp. | 134 | 541 | 428 | 72.6 | globlastp |
| ICM111_H3 | environmental sample | 135 | 542 | 428 | 70.8 | globlastp |
| ICM125_H1 | Morganella Sp. | 136 | 543 | 430 | 92.8 | globlastp |
| ICM125_H2 | Morganella Sp. | 137 | 544 | 430 | 90.9 | globlastp |
| ICM125_H3 | Morganella Sp. | 138 | 545 | 430 | 86.7 | globlastp |
| ICM125_H4 | Morganella Sp. | 139 | 546 | 430 | 85.4 | globlastp |
| ICMO55 | Artificial Sequence | 140 | 547 | 432 | 99.8 | globlastp |
| ICMO53 | Artificial Sequence | 141 | 548 | 432 | 98.7 | globlastp |
| ICMO56 | Artificial Sequence | 142 | 549 | 432 | 97.7 | globlastp |
| ICMO44 | Artificial Sequence | 143 | 550 | 432 | 79.2 | globlastp |
| ICMO41 | Artificial Sequence | 144 | 551 | 432 | 77.6 | globlastp |
| ICM147_H19 | Artificial Sequence | 145 | 552 | 432 | 76.7 | globlastp |
| ICMO43 | Artificial Sequence | 146 | 553 | 432 | 73.1 | globlastp |
| ICMO36 | Artificial Sequence | 147 | 554 | 432 | 70.6 | globlastp |
| ICM149_H2 | Providencia Sp. | 148 | 555 | 433 | 79.9 | globlastp |
| ICM149_H1 | Providencia Sp. | 149 | 556 | 433 | 79.8 | globlastp |
| ICM166_H11 | Pseudomonas Sp. | 150 | 557 | 434 | 85.4 | globlastp |
| ICM166_H9 | Pseudomonas Sp. | 151 | 558 | 434 | 84.8 | globlastp |
| ICM174_H1 | Stenotrophomonas Sp. | 152 | 559 | 435 | 98.5 | globlastp |
| ICM191_H2 | Chryseobacterium Sp. | 153 | 560 | 436 | 78.3 | globlastp |
| ICM191_H3 | Chryseobacterium Sp. | 154 | 561 | 436 | 77.9 | globlastp |
| ICM191_H1 | Chryseobacterium Sp. | 155 | 562 | 436 | 76.4 | globlastp |
| ICM191_H4 | Chryseobacterium Sp. | 156 | 563 | 436 | 75.4 | globlastp |
| ICM191_H5 | Chryseobacterium Sp. | 157 | 564 | 436 | 70 | globlastp |
| ICM192_H1 | Dyadobacter Sp. | 158 | 565 | 437 | 84.8 | globlastp |
| ICM201_H1 | Pseudomonas Sp. | 159 | 566 | 438 | 98 | globlastp |
| ICM201_H13 | Pseudomonas Sp. | 160 | 567 | 438 | 97.9 | globlastp |
| ICM201_H14 | Pseudomonas Sp. | 161 | 568 | 438 | 95.4 | globlastp |
| ICM201_H15 | Pseudomonas Sp. | 162 | 569 | 438 | 94.5 | globlastp |
| ICM201_H5 | Pseudomonas Sp. | 163 | 570 | 438 | 93.1 | globlastp |
| ICM201_H16 | Pseudomonas Sp. | 164 | 571 | 438 | 91.6 | globlastp |
| ICM201_H17 | Pseudomonas Sp. | 165 | 572 | 438 | 90.9 | globlastp |
| ICM201_H18 | Pseudomonas Sp. | 166 | 573 | 438 | 89.2 | globlastp |
| ICM201_H19 | Pseudomonas Sp. | 167 | 574 | 438 | 88.9 | globlastp |
| ICM201_H20 | Pseudomonas Sp. | 168 | 575 | 438 | 87.8 | globlastp |
| ICM201_H11 | Pseudomonas Sp. | 169 | 576 | 438 | 86 | globlastp |
| ICM201_H12 | Pseudomonas Sp. | 170 | 577 | 438 | 85.7 | globlastp |
| ICM372_H1 | Pseudomonas Sp. | 171 | 578 | 439 | 71.3 | globlastp |
| ICM207_H3 | Pseudomonas Sp. | 172 | 579 | 439 | 70.9 | globlastp |
| ICM208_H17 | Pseudomonas Sp. | 173 | 580 | 440 | 99.2 | globlastp |
| ICM208_H16 | Pseudomonas sp. | 174 | 581 | 440 | 98.1 | globlastp |
| ICM208_H24 | Pseudomonas Sp. | 175 | 582 | 440 | 97.9 | globlastp |
| ICM208_H9 | Pseudomonas Sp. | 176 | 583 | 440 | 93.5 | globlastp |
| ICM208_H19 | Pseudomonas Sp. | 177 | 584 | 440 | 92.4 | globlastp |
| ICM208_H20 | Pseudomonas Sp. | 178 | 585 | 440 | 88.3 | globlastp |
| ICM208_H25 | Pseudomonas Sp. | 179 | 586 | 440 | 87.9 | globlastp |
| ICM208_H7 | Pseudomonas Sp. | 180 | 587 | 440 | 85.4 | globlastp |
| ICM208_H22 | Pseudomonas Sp. | 181 | 588 | 440 | 80.7 | globlastp |
| ICM208_H23 | Pseudomonas Sp. | 182 | 589 | 440 | 74.9 | globlastp |
| ICM208_H15 | Pseudomonas sp. | 183 | 590 | 440 | 73.7 | globlastp |
| ICMO102 | Artificial Sequence | 184 | 591 | 441 | 99.8 | globlastp |
| ICMO93 | Artificial Sequence | 185 | 592 | 441 | 98.7 | globlastp |
| ICMO95 | Artificial Sequence | 186 | 593 | 441 | 97 | globlastp |
| ICM235_H1 | Photorhabdus Sp. | 187 | 594 | 442 | 96.7 | globlastp |
| ICM235_H2 | Photorhabdus Sp. | 188 | 595 | 442 | 95 | globlastp |

TABLE 11-continued

Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICM235_H4 | *Photorhabdus* Sp. | 189 | 596 | 442 | 94.5 | globlastp |
| ICM784 | *Photorhabdus* Sp. | 190 | 597 | 442 | 93.8 | globlastp |
| ICM236_H1 | *Photorhabdus* Sp. | 191 | 598 | 443 | 92.5 | globlastp |
| ICM236_H5 | *Photorhabdus* Sp. | 192 | 599 | 443 | 88.7 | globlastp |
| ICM236_H3 | *Photorhabdus* Sp. | 193 | 600 | 443 | 87.2 | globlastp |
| ICM236_H4 | *Photorhabdus* Sp. | 194 | 601 | 443 | 85.7 | globlastp |
| ICM785 | *Photorhabdus* Sp. | 195 | 602 | 443 | 82.7 | globlastp |
| ICM313_H1 | *Bacillus* Sp. | 196 | 603 | 447 | 92.3 | globlastp |
| ICM313_H2 | *Bacillus* Sp. | 197 | 604 | 447 | 79.4 | globlastp |
| ICM313_H3 | *Bacillus* Sp. | 198 | 605 | 447 | 74.6 | globlastp |
| ICM332_H9 | *Enterococcus* Sp. | 199 | 606 | 448 | 99.8 | globlastp |
| ICM332_H2 | *Enterococcus* Sp. | 200 | 607 | 448 | 94.2 | globlastp |
| ICM332_H3 | *Enterococcus* Sp. | 201 | 608 | 448 | 88.9 | globlastp |
| ICM332_H4 | *Enterococcus* Sp. | 202 | 609 | 448 | 85.2 | globlastp |
| ICM332_H5 | *Enterococcus* Sp. | 203 | 610 | 448 | 84.9 | globlastp |
| ICM332_H6 | *Enterococcus* Sp. | 204 | 611 | 448 | 82.6 | globlastp |
| ICM332_H7 | *Enterococcus* Sp. | 205 | 612 | 448 | 80.7 | globlastp |
| ICM332_H10 | *Enterococcus* Sp. | 206 | 613 | 448 | 79.6 | globlastp |
| ICM333_H29 | *Enterococcus* Sp. | 207 | 614 | 449 | 99.9 | globlastp |
| ICM333_H30 | *Enterococcus* Sp. | 208 | 615 | 449 | 98.9 | globlastp |
| ICM333_H7 | *Enterococcus* Sp. | 209 | 616 | 449 | 97.9 | globlastp |
| ICM333_H20 | *Enterococcus* Sp. | 210 | 617 | 449 | 95.5 | globlastp |
| ICM333_H8 | *Enterococcus* Sp. | 211 | 618 | 449 | 94.8 | globlastp |
| ICM333_H21 | *Enterococcus* Sp. | 212 | 619 | 449 | 93.6 | globlastp |
| ICM333_H22 | *Enterococcus* Sp. | 213 | 620 | 449 | 86.7 | globlastp |
| ICM333_H23 | *Enterococcus* Sp. | 214 | 621 | 449 | 85.7 | globlastp |
| ICM333_H4 | *Enterococcus* Sp. | 215 | 622 | 449 | 82.5 | globlastp |
| ICM333_H25 | *Enterococcus* Sp. | 216 | 623 | 449 | 80.1 | globlastp |
| ICM333_H26 | *Enterococcus* Sp. | 217 | 624 | 449 | 77.2 | globlastp |
| ICM333_H27 | *Enterococcus* Sp. | 218 | 625 | 449 | 73.2 | globlastp |
| ICM333_H11 | *Enterococcus* Sp. | 219 | 626 | 449 | 72.9 | globlastp |
| ICM333_H31 | *Enterococcus* Sp. | 220 | 627 | 449 | 71.9 | globlastp |
| ICM333_H28 | *Enterococcus* Sp. | 221 | 628 | 449 | 70.7 | globlastp |
| ICM349_H1 | *Providencia* Sp. | 222 | — | 450 | 84.86 | glotblastn |
| ICM207_H3 | *Pseudomonas* Sp. | 172 | 579 | 451 | 99.9 | globlastp |
| ICM372_H2 | *Pseudomonas* Sp. | 223 | 629 | 451 | 98.6 | globlastp |
| ICM372_H3 | *Pseudomonas* Sp. | 224 | 630 | 451 | 97.8 | globlastp |
| ICM372_H4 | *Pseudomonas* Sp. | 225 | 631 | 451 | 92.6 | globlastp |
| ICM207_H2 | *Pseudomonas* Sp. | 226 | 632 | 451 | 86.6 | globlastp |
| ICM372_H6 | *Pseudomonas* Sp. | 227 | 633 | 451 | 85.8 | globlastp |
| ICM372_H9 | *Pseudomonas* Sp. | 228 | 634 | 451 | 71.9 | globlastp |
| ICM425_H1 | environmental sample | 229 | 635 | 457 | 86 | globlastp |
| ICM457_H25 | *Bacillus* Sp. | 230 | 636 | 462 | 97.9 | globlastp |
| ICM457_H26 | *Bacillus* Sp. | 231 | 637 | 462 | 96.8 | globlastp |
| ICM457_H27 | *Bacillus* Sp. | 232 | 638 | 462 | 95.7 | globlastp |
| ICM457_H28 | *Bacillus* Sp. | 233 | 639 | 462 | 94.8 | globlastp |
| ICM457_H29 | *Bacillus* Sp. | 234 | 640 | 462 | 93.8 | globlastp |
| ICM457_H30 | *Bacillus* Sp. | 235 | 641 | 462 | 92.4 | globlastp |
| ICM457_H31 | *Bacillus* Sp. | 236 | 642 | 462 | 91.8 | globlastp |
| ICM457_H8 | *Bacillus* Sp. | 237 | 643 | 462 | 90.4 | globlastp |
| ICM457_H32 | *Bacillus* Sp. | 238 | 644 | 462 | 89.9 | globlastp |
| ICM457_H33 | *Bacillus* Sp. | 239 | 645 | 462 | 88.6 | globlastp |
| ICM457_H34 | *Bacillus* Sp. | 240 | 646 | 462 | 87.6 | globlastp |
| ICM457_H35 | *Bacillus* Sp. | 241 | 647 | 462 | 86.9 | globlastp |
| ICM457_H13 | *Bacillus* Sp. | 242 | 648 | 462 | 82.2 | globlastp |
| ICM457_H36 | *Bacillus* Sp. | 243 | 649 | 462 | 81.5 | globlastp |
| ICM457_H37 | *Bacillus* Sp. | 244 | 650 | 462 | 80.9 | globlastp |
| ICM457_H38 | *Bacillus* Sp. | 245 | 651 | 462 | 79.7 | globlastp |
| ICM457_H39 | *Bacillus* Sp. | 246 | 652 | 462 | 78.8 | globlastp |
| ICM457_H40 | *Bacillus* Sp. | 247 | 653 | 462 | 77.9 | globlastp |
| ICM457_H41 | *Bacillus* Sp. | 248 | 654 | 462 | 76.9 | globlastp |
| ICM457_H42 | *Bacillus* Sp. | 249 | 655 | 462 | 75.8 | globlastp |
| ICM457_H43 | *Bacillus* Sp. | 250 | 656 | 462 | 74.8 | globlastp |
| ICM457_H44 | *Bacillus* Sp. | 251 | 657 | 462 | 73.9 | globlastp |
| ICM457_H45 | *Bacillus* Sp. | 252 | 658 | 462 | 72.6 | globlastp |
| ICM457_H24 | *Bacillus* Sp. | 253 | 659 | 462 | 70 | globlastp |
| ICM458_H24 | *Bacillus* Sp. | 254 | 660 | 463 | 99.8 | globlastp |
| ICM458_H25 | *Bacillus* Sp. | 255 | 661 | 463 | 98.8 | globlastp |
| ICM458_H26 | *Bacillus* Sp. | 256 | 662 | 463 | 97.3 | globlastp |
| ICM458_H27 | *Bacillus* Sp. | 257 | 663 | 463 | 96.6 | globlastp |
| ICM458_H28 | *Bacillus* Sp. | 258 | 664 | 463 | 95.9 | globlastp |
| ICM458_H29 | *Bacillus* Sp. | 259 | 665 | 463 | 94.9 | globlastp |
| ICM458_H30 | *Bacillus* Sp. | 260 | 666 | 463 | 93.4 | globlastp |

TABLE 11-continued

Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICM458_H8 | Bacillus Sp. | 261 | 667 | 463 | 92.7 | globlastp |
| ICM458_H31 | Bacillus Sp. | 262 | 668 | 463 | 91 | globlastp |
| ICM458_H10 | Bacillus Sp. | 263 | 669 | 463 | 89.2 | globlastp |
| ICM458_H32 | Lysinibacillus Sp. | 264 | 670 | 463 | 88.9 | globlastp |
| ICM458_H33 | Bacillus Sp. | 265 | 671 | 463 | 87.8 | globlastp |
| ICM458_H34 | Bacillus Sp. | 266 | 672 | 463 | 86.5 | globlastp |
| ICM458_H35 | Bacillus Sp. | 267 | 673 | 463 | 85.8 | globlastp |
| ICM458_H36 | Bacillus Sp. | 268 | 674 | 463 | 84.9 | globlastp |
| ICM458_H37 | Bacillus Sp. | 269 | 675 | 463 | 83.1 | globlastp |
| ICM458_H38 | Bacillus Sp. | 270 | 676 | 463 | 82.9 | globlastp |
| ICM458_H18 | Bacillus Sp. | 271 | 677 | 463 | 81.9 | globlastp |
| ICM458_H39 | Bacillus Sp. | 272 | 678 | 463 | 80.9 | globlastp |
| ICM458_H20 | Bacillus Sp. | 273 | 679 | 463 | 79.2 | globlastp |
| ICM458_H40 | Bacillus Sp. | 274 | 680 | 463 | 75.3 | globlastp |
| ICM458_H22 | Bacillus Sp. | 275 | 681 | 463 | 74.6 | globlastp |
| ICM458_H23 | Bacillus Sp. | 276 | 682 | 463 | 72.1 | globlastp |
| ICM459_H14 | Bacillus Sp. | 277 | 683 | 464 | 98.9 | globlastp |
| ICM459_H15 | Bacillus Sp. | 278 | 684 | 464 | 97.9 | globlastp |
| ICM459_H16 | Bacillus Sp. | 279 | 685 | 464 | 96.8 | globlastp |
| ICM459_H17 | Bacillus Sp. | 280 | 686 | 464 | 95.5 | globlastp |
| ICM459_H18 | Bacillus Sp. | 281 | 687 | 464 | 94.7 | globlastp |
| ICM459_H6 | Bacillus Sp. | 282 | 688 | 464 | 93.4 | globlastp |
| ICM459_H19 | Bacillus Sp. | 283 | 689 | 464 | 91.8 | globlastp |
| ICM459_H20 | Bacillus Sp. | 284 | 690 | 464 | 89.9 | globlastp |
| ICM459_H9 | Bacillus Sp. | 285 | 691 | 464 | 87.3 | globlastp |
| ICM459_H10 | Bacillus Sp. | 286 | 692 | 464 | 85.6 | globlastp |
| ICM459_H11 | Bacillus Sp. | 287 | 693 | 464 | 84.1 | globlastp |
| ICM459_H21 | Bacillus Sp. | 288 | 694 | 464 | 71.2 | globlastp |
| ICM459_H22 | Bacillus Sp. | 289 | 695 | 464 | 70.7 | globlastp |
| ICM471_H7 | Photorhabdus Sp. | 290 | 696 | 466 | 89 | globlastp |
| ICM471_H2 | Photorhabdus Sp. | 291 | 697 | 466 | 88.7 | globlastp |
| ICM471_H3 | Photorhabdus Sp. | 292 | 698 | 466 | 87.1 | globlastp |
| ICM471_H4 | Photorhabdus Sp. | 293 | 699 | 466 | 73 | globlastp |
| ICM471_H8 | Photorhabdus Sp. | 294 | 700 | 466 | 72.4 | globlastp |
| ICM471_H9 | Photorhabdus Sp. | 295 | 701 | 466 | 70.8 | globlastp |
| ICM485_H1 | Xenorhabdus Sp. | 296 | — | 469 | 92.21 | glotblastn |
| ICMO99 | Artificial Sequence | 297 | 702 | 470 | 99.8 | globlastp |
| ICMO101 | Artificial Sequence | 298 | 703 | 470 | 99.6 | globlastp |
| ICMO100 | Artificial Sequence | 299 | 704 | 470 | 85.5 | globlastp |
| ICM503_H1 | Lactococcus Sp. | 101 | 508 | 471 | 99.6 | globlastp |
| ICM503_H2 | Lactococcus Sp. | 102 | 509 | 471 | 99.6 | globlastp |
| ICM11_H2 | Lactococcus Sp. | 100 | 705 | 471 | 81.5 | globlastp |
| ICM573_H1 | Microcoleus Sp. | 300 | 706 | 474 | 93.2 | globlastp |
| ICM573_H2 | Oscillatoria Sp. | 301 | 707 | 474 | 91.8 | globlastp |
| ICM579_H1 | environmental sample | 302 | 708 | 476 | 72.9 | globlastp |
| ICM614_H12 | Enterococcus Sp. | 303 | 709 | 479 | 99.9 | globlastp |
| ICM614_H13 | environmental sample | 304 | 710 | 479 | 96.5 | globlastp |
| ICM614_H3 | Enterococcus Sp. | 305 | 711 | 479 | 95.8 | globlastp |
| ICM614_H4 | Enterococcus Sp. | 306 | 712 | 479 | 86.7 | globlastp |
| ICM614_H5 | Enterococcus Sp. | 307 | 713 | 479 | 82 | globlastp |
| ICM614_H6 | Enterococcus Sp. | 308 | 714 | 479 | 80.8 | globlastp |
| ICM614_H7 | Enterococcus Sp. | 309 | 715 | 479 | 79.6 | globlastp |
| ICM614_H8 | Enterococcus Sp. | 310 | 716 | 479 | 78.3 | globlastp |
| ICM614_H9 | Enterococcus Sp. | 311 | 717 | 479 | 73.9 | globlastp |
| ICM614_H10 | Enterococcus Sp. | 312 | 718 | 479 | 72.7 | globlastp |
| ICM614_H11 | Enterococcus Sp. | 313 | 719 | 479 | 70.8 | globlastp |
| ICM621_H1 | Pantoea Sp. | 314 | 720 | 480 | 95.9 | globlastp |
| ICM621_H2 | environmental sample | 315 | 721 | 480 | 82.3 | globlastp |
| ICM623_H1 | environmental sample | 316 | 722 | 481 | 97.9 | globlastp |
| ICM623_H2 | Lactococcus Sp. | 317 | 723 | 481 | 79.7 | globlastp |
| ICM623_H3 | Lactococcus Sp. | 318 | 724 | 481 | 75.3 | globlastp |
| ICM623_H4 | Lactococcus Sp. | 319 | — | 481 | 71.16 | glotblastn |
| ICMO36 | Artificial Sequence | 147 | 554 | 482 | 77.8 | globlastp |
| ICM147_H19 | Artificial Sequence | 145 | 552 | 482 | 74.9 | globlastp |
| ICM147_H14 | Providencia Sp. | 320 | 725 | 482 | 73.5 | globlastp |
| ICMO44 | Artificial Sequence | 143 | 550 | 482 | 71.5 | globlastp |
| ICMO3 | Artificial Sequence | 321 | 726 | 483 | 99.8 | globlastp |
| ICMO4 | Artificial Sequence | 322 | 727 | 483 | 98.7 | globlastp |
| ICMO18 | Artificial Sequence | 323 | 728 | 483 | 96.7 | globlastp |
| ICMO17 | Artificial Sequence | 324 | 729 | 483 | 95.7 | globlastp |
| ICMO11 | Artificial Sequence | 325 | 730 | 483 | 94.6 | globlastp |
| ICM147_H40 | Chryseobacterium sp. | 326 | 731 | 483 | 93.8 | globlastp |
| ICM147_H33 | Chryseobacterium sp. | 327 | 732 | 483 | 92.9 | globlastp |

TABLE 11-continued

Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICM147_H21 | Artificial Sequence | 328 | 733 | 483 | 90.4 | globlastp |
| ICMO9 | Artificial Sequence | 329 | 734 | 483 | 88.6 | globlastp |
| ICM147_H39 | Chryseobacterium sp. | 330 | 735 | 483 | 85.6 | globlastp |
| ICMO6 | Artificial Sequence | 331 | 736 | 483 | 84.6 | globlastp |
| ICMO15 | Artificial Sequence | 332 | 737 | 483 | 82.1 | globlastp |
| ICMO8 | Artificial Sequence | 333 | 738 | 483 | 81.4 | globlastp |
| ICM147_H55 | Chryseobacterium sp. | 334 | 739 | 483 | 80.6 | globlastp |
| ICM147_H47 | Chryseobacterium sp. | 335 | 740 | 483 | 79.5 | globlastp |
| ICMO23 | Artificial Sequence | 336 | 741 | 483 | 78 | globlastp |
| ICM147_H10 | Chryseobacterium Sp. | 337 | 742 | 483 | 77.1 | globlastp |
| ICM147_H53 | environmental sample | 338 | 743 | 483 | 76.4 | globlastp |
| ICMO5 | Artificial Sequence | 339 | 744 | 483 | 75.1 | globlastp |
| ICMO22 | Artificial Sequence | 340 | 745 | 483 | 70.3 | globlastp |
| ICM147_H45 | Chryseobacterium sp. | 341 | 746 | 484 | 99.5 | globlastp |
| ICMO9 | Artificial Sequence | 329 | 734 | 484 | 89.3 | globlastp |
| ICMO16 | Artificial Sequence | 342 | 747 | 484 | 87.5 | globlastp |
| ICM147_H21 | Artificial Sequence | 328 | 733 | 484 | 84.7 | globlastp |
| ICMO14 | Artificial Sequence | 343 | 748 | 484 | 83.7 | globlastp |
| ICM147_H20 | Artificial Sequence | 344 | 749 | 484 | 82.4 | globlastp |
| ICM147_H39 | Chryseobacterium sp. | 330 | 735 | 484 | 80.7 | globlastp |
| ICM147_H46 | Chryseobacterium sp. | 345 | 750 | 484 | 79.9 | globlastp |
| ICM147_H37 | Chryseobacterium sp. | 346 | 751 | 484 | 78.6 | globlastp |
| ICM147_H10 | Chryseobacterium Sp. | 337 | 742 | 484 | 77.5 | globlastp |
| ICM147_H53 | environmental sample | 338 | 743 | 484 | 76.3 | globlastp |
| ICMO5 | Artificial Sequence | 339 | 744 | 484 | 74.8 | globlastp |
| ICMO19 | Artificial Sequence | 347 | 752 | 484 | 72 | globlastp |
| ICM147_H56 | Chryseobacterium sp. | 348 | 753 | 485 | 97.8 | globlastp |
| ICMO17 | Artificial Sequence | 324 | 729 | 485 | 96.7 | globlastp |
| ICM147_H34 | Chryseobacterium sp. | 349 | 754 | 485 | 95.8 | globlastp |
| ICM147_H40 | Chryseobacterium sp. | 326 | 731 | 485 | 93.1 | globlastp |
| ICMO3 | Artificial Sequence | 321 | 726 | 485 | 92.9 | globlastp |
| ICM147_H21 | Artificial Sequence | 328 | 733 | 485 | 91.5 | globlastp |
| ICM147_H37 | Chryseobacterium sp. | 346 | 751 | 485 | 90.9 | globlastp |
| ICMO16 | Artificial Sequence | 342 | 747 | 485 | 88.9 | globlastp |
| ICM147_H39 | Chryseobacterium sp. | 330 | 735 | 485 | 86.5 | globlastp |
| ICMO14 | Artificial Sequence | 343 | 748 | 485 | 85.3 | globlastp |
| ICMO19 | Artificial Sequence | 347 | 752 | 485 | 84.6 | globlastp |
| ICM147_H20 | Artificial Sequence | 344 | 749 | 485 | 83.9 | globlastp |
| ICMO15 | Artificial Sequence | 332 | 737 | 485 | 81.5 | globlastp |
| ICMO8 | Artificial Sequence | 333 | 738 | 485 | 80.9 | globlastp |
| ICM147_H47 | Chryseobacterium sp. | 335 | 740 | 485 | 79.7 | globlastp |
| ICM147_H46 | Chryseobacterium sp. | 345 | 750 | 485 | 78.8 | globlastp |
| ICMO23 | Artificial Sequence | 336 | 741 | 485 | 77.1 | globlastp |
| ICM147_H10 | Chryseobacterium Sp. | 337 | 742 | 485 | 76.5 | globlastp |
| ICMO5 | Artificial Sequence | 339 | 744 | 485 | 75.8 | globlastp |
| ICMO13 | Artificial Sequence | 350 | 755 | 485 | 70.1 | globlastp |
| ICM147_H40 | Chryseobacterium sp. | 326 | 731 | 486 | 97.1 | globlastp |
| ICMO12 | Artificial Sequence | 351 | 756 | 486 | 96.7 | globlastp |
| ICM147_H37 | Chryseobacterium sp. | 346 | 751 | 486 | 95.5 | globlastp |
| ICMO11 | Artificial Sequence | 325 | 730 | 486 | 94.7 | globlastp |
| ICM147_H34 | Chryseobacterium sp. | 349 | 754 | 486 | 93.8 | globlastp |
| ICM147_H52 | Chryseobacterium Sp. | 352 | 757 | 486 | 92.8 | globlastp |
| ICM147_H21 | Artificial Sequence | 328 | 733 | 486 | 89.7 | globlastp |
| ICMO16 | Artificial Sequence | 342 | 747 | 486 | 86.6 | globlastp |
| ICM147_H39 | Chryseobacterium sp. | 330 | 735 | 486 | 84.5 | globlastp |
| ICMO14 | Artificial Sequence | 343 | 748 | 486 | 83.7 | globlastp |
| ICMO6 | Artificial Sequence | 331 | 736 | 486 | 82.8 | globlastp |
| ICMO15 | Artificial Sequence | 332 | 737 | 486 | 81.2 | globlastp |
| ICMO8 | Artificial Sequence | 333 | 738 | 486 | 80.4 | globlastp |
| ICM147_H49 | Chryseobacterium sp. | 353 | 758 | 486 | 79.7 | globlastp |
| ICM147_H55 | Chryseobacterium sp. | 334 | 739 | 486 | 78.7 | globlastp |
| ICM147_H46 | Chryseobacterium sp. | 345 | 750 | 486 | 77.9 | globlastp |
| ICMO24 | Artificial Sequence | 354 | 759 | 486 | 76.7 | globlastp |
| ICM147_H53 | environmental sample | 338 | 743 | 486 | 75.9 | globlastp |
| ICMO5 | Artificial Sequence | 339 | 744 | 486 | 74.4 | globlastp |
| ICMO22 | Artificial Sequence | 340 | 745 | 486 | 70.5 | globlastp |
| ICM149_H4 | Providencia sp. | 355 | 760 | 487 | 99.3 | globlastp |
| ICM149_H5 | Providencia sp. | 356 | 761 | 487 | 98.8 | globlastp |
| ICM162_H5 | environmental sample | 357 | 762 | 488 | 71.1 | globlastp |
| ICM162_H8 | environmental sample | 358 | 763 | 488 | 71 | globlastp |
| ICM1_H4 | Yersinia Sp. | 359 | 764 | 489 | 97.8 | globlastp |
| ICM1_H5 | Yersinia Sp. | 360 | 765 | 489 | 93.8 | globlastp |
| ICM1_H6 | Yersinia Sp. | 361 | 766 | 489 | 92.8 | globlastp |

TABLE 11-continued

Homologues (e.g., orthologues) of the identified insecticidal genes/polypeptides retaining insecticidal activity by themselves

| Homolog Gene name | Organism | Polyn. SEQ ID NO: | Polyp. SEQ ID NO: | Hom. to SEQ ID NO: | % glob. Iden. | Algor. |
|---|---|---|---|---|---|---|
| ICM1_H7 | *Yersinia* Sp. | 362 | 767 | 489 | 86.3 | globlastp |
| ICM787 | *Yersinia* Sp. | 363 | 768 | 489 | 83.4 | globlastp |
| ICM1_H3 | *Yersinia* Sp. | 364 | — | 489 | 72.84 | glotblastn |
| ICM2_H2 | *Yersinia* Sp. | 365 | 769 | 490 | 94.9 | globlastp |
| ICM2_H3 | *Yersinia* Sp. | 366 | 770 | 490 | 92.6 | globlastp |
| ICM2_H4 | *Yersinia* Sp. | 367 | 771 | 490 | 75.9 | globlastp |
| ICMO97 | Artificial Sequence | 368 | 772 | 491 | 99.8 | globlastp |
| ICMO91 | Artificial Sequence | 369 | 773 | 491 | 98.9 | globlastp |
| ICMO92 | Artificial Sequence | 370 | 774 | 491 | 97.4 | globlastp |
| ICM86_H30 | *Curtobacterium* Sp. | 371 | 775 | 493 | 86.6 | globlastp |
| ICM86_H29 | *Pseudomonas* Sp. | 372 | 776 | 495 | 94.2 | globlastp |
| ICM86_H31 | *Pantoea* Sp. | 373 | 777 | 496 | 87.3 | globlastp |
| POC1_H1 | *Arsenophonus* Sp. | 374 | 778 | 497 | 84.5 | globlastp |
| POC99_H6 | *Yersinia* Sp. | 375 | 779 | 498 | 99.8 | globlastp |
| POC99_H17 | *Yersinia* Sp. | 376 | 780 | 498 | 98.9 | globlastp |
| POC99_H18 | *Yersinia* Sp. | 377 | 781 | 498 | 94.8 | globlastp |
| POC99_H19 | *Yersinia* Sp. | 378 | 782 | 498 | 90.4 | globlastp |
| POC99_H20 | *Yersinia* Sp. | 379 | 783 | 498 | 86.4 | globlastp |
| POC99_H21 | *Yersinia* Sp. | 380 | 784 | 498 | 85.8 | globlastp |
| POC99_H12 | *Yersinia* Sp. | 381 | 785 | 498 | 84.7 | globlastp |
| POC99_H5 | *Yersinia* Sp. | 382 | 786 | 498 | 83.9 | globlastp |
| POC99_H13 | *Yersinia* Sp. | 383 | 787 | 498 | 82 | globlastp |
| POC99_H22 | *Yersinia* Sp. | 384 | 788 | 498 | 81.5 | globlastp |
| POC99_H23 | *Yersinia* Sp. | 385 | 789 | 498 | 80.8 | globlastp |
| POC99_H24 | *Yersinia* Sp. | 386 | 790 | 498 | 79.4 | globlastp |
| POC99_H2 | *Yersinia* Sp. | 387 | 791 | 498 | 78.5 | globlastp |
| PUB28_H1 | *Bacillus* Sp. | 388 | 792 | 500 | 76.9 | globlastp |
| PUB81_H1 | *Brevibacillus* Sp. | 389 | 793 | 501 | 99 | globlastp |
| PUB81_H7 | *Brevibacillus* Sp. | 390 | 794 | 501 | 98.5 | globlastp |
| PUB81_H3 | *Brevibacillus* Sp. | 391 | 795 | 501 | 96.1 | globlastp |
| PUB81_H8 | *Brevibacillus* Sp. | 392 | 796 | 501 | 86.5 | globlastp |
| PUB12 | *Brevibacillus* Sp. | 393 | 797 | 501 | 85.4 | globlastp |
| PUB81_H6 | *Brevibacillus* Sp. | 394 | 798 | 501 | 84.8 | globlastp |
| PUB85_H1 | *Bacillus* Sp. | 395 | 799 | 502 | 95.6 | globlastp |
| PUB85_H14 | *Bacillus* Sp. | 396 | 800 | 502 | 94.9 | globlastp |
| PUB85_H3 | *Bacillus* Sp. | 397 | 801 | 502 | 93 | globlastp |
| PUB85_H15 | *Bacillus* Sp. | 398 | 802 | 502 | 91.7 | globlastp |
| PUB85_H16 | *Bacillus* Sp. | 399 | 803 | 502 | 89.3 | globlastp |
| PUB85_H6 | *Bacillus* Sp. | 400 | 804 | 502 | 88.8 | globlastp |
| PUB85_H7 | *Bacillus* Sp. | 401 | 805 | 502 | 87.3 | globlastp |
| PUB84 | *Bacillus* Sp. | 402 | 806 | 502 | 81.9 | globlastp |
| PUB85_H8 | *Bacillus* Sp. | 403 | 807 | 502 | 77 | globlastp |
| PUB85_H17 | *Bacillus* Sp. | 404 | 808 | 502 | 76.6 | globlastp |
| PUB85_H18 | *Bacillus* Sp. | 405 | — | 502 | 75.98 | glotblastn |
| PUB85_H11 | *Bacillus* Sp. | 406 | — | 502 | 74.84 | glotblastn |
| PUB85_H12 | *Bacillus* Sp. | 407 | — | 502 | 71.79 | glotblastn |
| PUB85_H19 | *Bacillus* Sp. | 408 | 809 | 502 | 70.4 | globlastp |

Table 11: "Polyn." = polynucleotide; "Polyp." = polypeptide; "Algor." = algorithm (used for sequence alignment and determination of percent homology); "Hom."—homology; "iden."—identity; "glob."—global.

Example 3: Identification of Domains Shared by Insecticidal Polypeptides

A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability and/or function of a protein. Identified by their high degree of conservation in aligned sequences of a family of protein homologues, they can be used as identifiers to determine if any polypeptide in question belongs to a previously identified polypeptide family.

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom.

Interpro is hosted at the European Bioinformatics Institute in the United Kingdom. InterProScan is the software package that allows sequences (protein and nucleic acid sequences) to be scanned against InterPro's signatures. Signatures are predictive models, provided by several different databases that make up the InterPro consortium.

InterProScan 5.32-71.0 was used to analyze the polypeptides of some embodiments of the invention (core polypeptides as well as homologues and/or orthologues thereof) for common domains [Jones P et al., 2014. Bioinformatics, January 2014 (doi:10.1093/bioinformatics/btu031)]. Briefly, InterProScan is based on scanning methods native to the InterPro member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam filtering: Each Pfam family is represented by two hidden Markov models (HMMs)—ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped.

If both the fs and ls model for a particular Pfam hits the same region of a sequence, the Alignment Method (AM) field in the Pfam database is used to determine which model should be chosen—globalfirst (LS); localfirst (FS) or byscore (whichever has the highest e-value).

Another type of filtering has been implemented since release 4.1. It is based on Clan filtering and nested domains. Further information on Clan filtering can be found in the Pfam website [worldwideweb.sanger.ac.uk/Pfam] for more information on Clan filtering.

TIGRFAMs filtering: Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS filtering: All matches with p-value more than a pre-set minimum value for the signature are dropped.

SMART filtering: The publicly distributed version of InterProScan has a common e-value cut-off corresponding to the reference database size. A more sophisticated scoring model is used on the SMART web server and in the production of pre-calculated InterPro match data.

Exact scoring thresholds for domain assignments are proprietary data. The InterProMatches data production procedure uses these additional smart thresholds data. It is to be noted that the given cut-offs are e-values (i.e., the number of expected random hits) and therefore are only valid in the context of reference database size and of data files for filtering out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined) and if the domain E-value is worse than the domain cut off ('cutoff') then the match is dropped. If the signature has "siblings" (because it has a family_cut defined), and they overlap, the preferred sibling is chosen as the true match according to information in the overlaps file.

PROSITE patterns CONFIRMation: ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of 10e' P-value.

PANTHER filtering: Panther has pre- and post-processing steps. The pre-processing step is intended to speed up the HMM-based searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against).

Any matches that score below the e-value cut-off are discarded. Any remaining matches are searched to find the HMM with the best score and e-value and the best hit is then reported (including any sub-family hit).

GENE3D filtering: Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of some embodiments of the invention, having insecticidal effects, can be characterized by specific amino acid domains. According to certain embodiments of the invention, particular domains are conserved within a family of polypeptides as described in Table 12 hereinbelow. Without wishing to be bound by specific theory or mechanism of action, the conserved domain may indicate common function of the polypeptides comprising same. The domains are presented by an arbitrary identifier (*ID). Table 13 provides the details of each domain according to the InterPro Entry.

Table 12 summarizes the domains in each of the "core" polypeptides (e.g., the polypeptides from Table 10 identified by the inventors of the present invention as pesticidal polypeptides), wherein each of the listed domains is conserved in the representative homologous polypeptides identified herein (as detailed in Table 11 in Example 2 above) exhibiting at least 70% global identity to the "core" polypeptides. As explained above, each domain received an arbitrary ID number (e.g., from 1-98), wherein description of these arbitrary domain IDs according to the InterPro database is provided in Table 13 below. In addition, the start and end positions of each of the domains is indicated with respect to the amino acid sequence of the "core" polypeptide. Table 12 also provides the E-values for each of the conserved domains as indicated by the domain tool used for analyzing these sequences, as part of interproscan programs, e.g., SMART, prosite scans patterns and profiles. For example, in the case of the Prosite search, the Prosite profiles report normalized scores instead of E-values, which are defined as the base 10 logarithm of the size (in residues) of the database in which one false positive match is expected to occur by chance. The normalized score is independent of the size of the databases searched. The so-called bit scores reported by other database-search programs have a distinct meaning but are also independent of the size of the database searched.

For example, for SEQ ID NO: 409, the domain ID "1" appears at amino acid positions 20 through 249 (marked as "20_249"). In addition, the annotation appears with normalized score of 1.9E-51. It is further noted that for some domains the e-value is not specified and instead there is a mark of "-;". In these cases (-;) the presence of the domain was verified by ScanRegExp, which is able to verify PROSITE matches using corresponding statistically-significant CONFIRM patterns. The CONFIRM patterns were generated based on the true positive SWISS-PROT PROSITE matches using eMOTIF software with a stringency of 10e-9 P-value. Further details can be found in hypertext transfer protocol://computing.bio.cam.ac.uk/local/doc/iprscan.html.

TABLE 12

Domains of "core" polypeptides capable of insecticidal activity

| Polyp. (S

TABLE 12-continued

| Polyp. (SEQ ID NO) | Domains by ID* | Amino acid Positions of Start-End of the Domain Match | E-value of the Domain Match** | Domains by ID* common to core and homologs | Homologs (SEQ ID NO) sharing common domains |
|---|---|---|---|---|---|
| Domains of "core" polypeptides capable of insecticidal activity | | | | | |
| 424 | no known domains in core | | | | |
| 425 | 32; 33; 30; 34; 35; 35; 35; 30; 35; 35; 35; 29; 31 | 17__206; 17__203; 212__295; 213__391; 214__285; 214__295; 216__298; 302__391; 305__391; 305__380; 307__394; 403__450; 406__448 | 1.36E−44; 2.2E−36; 7.0E−18; 2.16E−22; 1.0E−7; 1.46591E−7; 13.239; 1.4E−17; 1.96454E−7; 1.6E−6; 13.823; 0.0017; 4.97E−9 | 29; 30; 31; 32; 33; 34; 35 in core | |
| 426 | 13 | 964__987 | 2.30E−04 | 13 in core | NA |
| 427 | 36 | 51__150 | 6.50E−33 | 36 in core and homologs | 539 |
| 428 | no known domains in core | | | | |
| 429 | 37 | 15__187 | 3.20E−20 | 37 in core | NA |
| 430 | 1; 1 | 15__210; 46__195 | 3.1E−8; 3.27E−7 | 1 in core and homologs | 543; 544; 545; 546 |
| 431 | 16 | 582__662 | 4.80E−25 | 16 in core | NA |
| 432 | 5; 5; 8; 7; 8; 8; 38 | 209__508; 227__493; 242__261; 273__484; 276__289; 444__460; 445__455 | 4.7E−38; 2.75E−37; 5.2E−10; 6.0E−13; 5.2E−10; 5.2E−10; — | 5; 7; 8; 38 in core and homologs | 547; 548; 549; 550; 551; 552; 553; 554 |
| 433 | 40; 41; 42; 42; 42; 30; 39; 39; 30 | 74__348; 110__355; 199__214; 228__247; 383__395; 463__578; 474__569; 583__680; 588__681 | 9.2E−87; 2.2E−90; 5.2E−6; 5.2E−6; 5.2E−6; 2.8E−10; 1.07E−5; 7.46E−10; 8.1E−11 | 39; 40; 30; 41; 42 in core and homologs | 555; 556 |
| 434 | 47; 48; 46; 49; 43; 43; 44; 45 | 29__240; 45__214; 56__237; 238__442; 240__441; 241__442; 322__356; 511__723 | 2.7E−163; 3.5E−13; 9.22914E−40; 6.0E−68; 2.09E−38; 2.7E−163; 1.1E−6; 6.23E−18 | 43; 44; 45; 46; 47; 48; 49 in core and homologs | 557; 558 |
| 435 | 1; 1; 27 | 122__345; 133__342; 136__290 | 1.7E−29; 5.49E−25; 6.7E−7 | 27; 1 in core and homologs | 559 |
| 436 | 53; 53; 53; 53; 50; 52; 51 | 243__759; 272__291; 311__331; 370__390; 442__529; 582__777; 796__871 | 1.6E−137; 6.8E−11; 6.8E−11; 6.8E−11; 2.6E−13; 3.4E−60; 2.2E−14 | 50; 51; 52; 53 in core and homologs | 560; 561; 562; 563; 564 |
| 437 | 54; 55; 30; 51 | 137__360; 138__379; 499__588; 601__672 | 6.5E−10; 6.0E−11; 4.1E−7; 1.2E−12 | 51; 54; 30; 55 in core and homologs | 565 |
| 438 | 56 | 25__340 | 2.70E−56 | 56 in core and homologs | 566; 567; 568; 569; 570; 571; 572; 573; 574; 575; 576; 577 |
| 439 | 56 | 25__296 | 1.40E−47 | 56 in core and homologs | 578; 579 |
| 440 | 16; 57 | 573__652; 606__909 | 2.4E−25; 8.44E−45 | 16; 57 in core and homologs | 580; 581; 582; 583; 584; 585; 586; 587; 588; 589; 590 |
| 441 | 58; 1; 27; 1 | 1__37; 48__272; 58__228; 59__224 | 8.521; 2.7E−31; 6.6E−14; 2.35E−25 | 27; 1; 58 in core and homologs | 591; 592; 593 |
| 442 | 1; 1; 27 | 1__239; 16__250; 36__215 | 4.97E−41; 2.3E−57; 8.3E−8 | 27; 1 in core and homologs | 594; 595; 596; 597 |
| 443 | no known domains in core | | | | |
| 444 | 59 | 64__187 | 2.00E−06 | 59 in core | NA |
| 445 | 61; 61; 60; 60 | 173__452; 179__447; 185__330; 216__330 | 5.4E−80; 5.75E−49; 8.6E−10; 4.7E−8 | 60; 61 in core | NA |

TABLE 12-continued

Domains of "core" polypeptides capable of insecticidal activity

| Polyp. (SEQ ID NO) | Domains by ID* | Amino acid Positions of Start-End of the Domain Match | E-value of the Domain Match** | Domains by ID* common to core and homologs | Homologs (SEQ ID NO) sharing common TABLE 12-continued Domains of "core" polypeptides capable of insecticidal activity

| Polyp. (SEQ ID NO) | Domains by ID* | Amino acid Positions of Start-End of the Domain Match | E-value of the Domain Match** | Domains by ID* common to core and homologs | Homologs (SEQ ID NO) sharing common domains |
|---|---|---|---|---|---

TABLE 12-continued

| Polyp. (SEQ ID NO) | Domains by ID* | Amino acid Positions of Start-End of the Domain Match | E-value of the Domain Match** | Domains by ID* common to core and homologs | Homologs (SEQ ID NO) sharing common domains |
|---|---|---|---|---|---|
| Domains of "core" polypeptides capable of insecticidal activity | | | | | |
| | | | | | 738; 739; 740; 741; 742; 743; 744; 745 |
| 484 | 5; 5; 8; 7; 8; 8; 51 | 149__470; 162__460; 176__195; 207__438; 217__230; 397__413; 481__551 | 2.0E−41; 7.33E−39; 1.7E−5; 1.7E−19; 1.7E−5; 1.7E−5; 1.5E−14 | 51; 5; 7; 8 in core and homologs | 733; 734; 735; 742; 743; 744; 746; 747; 748; 749; 750; 751; 752 |
| 485 | 5; 5; 7; 51 | 150__470; 163__461; 215__438; 481__550 | 1.9E−40; 8.9E−37; 8.1E−17; 3.9E−13 | 51; 5; 7 in core and homologs | 726; 729; 731; 733; 735; 737; 738; 740; 741; 742; 744; 747; 748; 749; 750; 751; 752; 753; 754; 755 |
| 486 | 5; 5; 8; 7; 8; 8 | 150__470; 163__461; 177__196; 215__438; 218__231; 398__414 | 7.9E−40; 2.09E−36; 4.5E−5; 5.2E−19; 4.5E−5; 4.5E−5 | 5; 7; 8 in core and homologs | 730; 731; 733; 735; 736; 737; 738; 739; 743; 744; 745; 747; 748; 750; 751; 754; 756; 757; 758; 759 |
| 487 | 40; 41; 42; 42; 42; 30; 39; 39; 30; 95; 95 | 78__350; 112__357; 201__216; 230__249; 298__317; 468__585; 475__572; 585__681; 591__683; 593__679; 606__668 | 7.2E−92; 2.2E−93; 1.1E−8; 1.1E−8; 1.1E−8; 1.6E−12; 4.4E−7; 1.16E−11; 8.8E−13; 0.0063; 4.9E−10 | 40; 39; 30; 41; 95; 42 in core and homologs | 760; 761 |
| 488 | 30; 30 | 356__450; 532__619 | 2.6E−6; 7.1E−14 | 30 in core and homologs | 762; 763 |
| 489 | 1; 1; 27 | 18__249; 27__240; 39__206 | 3.8E−51; 9.81E−30; 5.3E−8 | 27; 1 in core and homologs | 764; 765; 766; 767; 768 |
| 490 | no known domains in core | | | | |
| 491 | 1; 1; 27 | 49__269; 63__270; 160__220 | 2.0E−31; 1.96E−27; 3.1E−7 | 27; 1 in core and homologs | 772; 773; 774 |
| 492 | 32; 33; 30; 34; 35; 35; 35; 30; 35; 35; 35; 29; 31 | 18__206; 18__204; 214__302; 216__401; 216__302; 216__292; 218__305; 309__398; 312__398; 312__388; 314__401; 406__455; 408__454 | 2.66E−43; 2.7E−31; 5.7E−14; 2.7E−20; 2.85509E−6; 0.0014; 12.174; 9.7E−15; 2.44585E−5; 0.13; 12.166; 2.0E−8; 1.83E−8 | 29; 30; 31; 32; 33; 34; 35 in core | NA |
| 493 | 32; 33; 30; 34; 35; 35; 35; 35; 30; 35; 35; 29; 31 | 49__201; 58__199; 216__309; 217__401; 217__313; 218__297; 218__300; 226__297; 315__400; 317__389; 319__403; 408__454; 411__452 | 1.22E−50; 7.8E−34; 5.9E−12; 4.36E−20; 14.272; 8.57321E−10; 7.4E−7; 6.7E−6; 7.2E−13; 1.5E−4; 10.557; 0.0074; 1.31E−6 | 29; 31; 30; 32; 34; 33; 35 in core and homologs | 775 |
| 494 | 32; 33; 30; 34; 35; 35; 35; 30; 35; 35; 35; 29; 31 | 10__200; 10__197; 206__297; 207__393; 208__287; 208__297; 210__300; 305__392; 307__392; 307__382; 309__395; 398__445; 406__444 | 3.5E−41; 1.7E−28; 3.6E−17; 6.32E−26; 1.3E−5; 1.60939E−10; 16.19; 7.1E−15; 4.84213E−8; 3.4E−5; 12.805; 3.2E−5; 6.93E−11 | 29; 30; 31; 32; 34; 33; 35 in core | NA |
| 495 | 32; 33; 30; 34; 35; 35; 35; 30; 35; 35; 35; 35; | 17__206; 17__203; 214__301; 214__398; 215__301; 215__290; 217__304; 309__397; 311__397; | 1.54E−43; 7.4E−32; 1.5E−14; 5.0E−23; 1.62389E−5; 6.3E−4; 12.671; 8.8E−19; | 29; 31; 30; 32; 34; 33; 35 in core and | 776 |

TABLE 12-continued

Domains of "core" polypeptides capable of insecticidal activity

| Polyp. (SEQ ID NO) | Domains by ID* | Amino acid Positions of Start-End of the Domain Match | E-value of the Domain Match** | Domains by ID* common to core and homologs | Homologs (SEQ ID NO) sharing common domains |

TABLE 13-continued

Details of Identified Domains

| Domain Identifier (ID) | InterPro number | Accession number in source database | Description of IPR |
|---|---|---|---|
| 7 | IPR000209 | PF00082 | Subtilase family Peptidase S8/S53 domain |
| 8 | IPR015500 | PR00723 | Subtilisin serine protease family (S8) signature Peptidase S8, subtilisin-related |
| 9 | IPR011050 | SSF51126 | Pectin lyase fold/virulence factor |
| 10 | IPR006315 | TIGR01414 | autotrans_barl: outer membrane autotransporter barrel domain |
| 11 | IPR036709 | G3DSA:2.40.128.130 | Autotransporter beta-domain superfamily |
| 12 | IPR022398 | PS00137 | Serine proteases, subtilase family, histidine active site. Peptidase S8, subtilisin, His-active site |
| 13 | IPR006530 | TIGR01643 | YD_repeat_2x: YD repeat (two copies) YD repeat |
| 14 | IPR001826 | PF03527 | RHS protein |
| 15 | IPR031325 | PF05593 | RHS Repeat |
| 16 | IPR022385 | TIGR03696 | Rhs_assc_core: RHS repeat-associated core domain |
| 17 | IPR008727 | PF05488 | PAAR motif |
| 18 | IPR005565 | PF03865 | Haemolysin secretion/activation protein ShlB/FhaC/HecB Haemolysin activator HlyB, C-terminal |
| 19 | IPR027282 | PIRSF029745 | Two partner secretion pathway transporter |
| 20 | IPR035251 | PF17287 | POTRA domain ShlB, POTRA domain |
| 21 | IPR013686 | PF08479 | POTRA domain, ShlB-type Polypeptide-transport-associated, ShlB-type |
| 22 | IPR029487 | PF14496 | C-terminal novel E3 ligase, LRR-interacting Novel E3 ligase domain |
| 23 | IPR003591 | SM00369 | Leucine-rich repeat, typical subtype |
| 24 | IPR001611 | PS51450 | Leucine-rich repeat profile |
| 25 | IPR032675 | G3DSA:3.80.10.10 | Leucine-rich repeat domain superfamily |
| 26 | IPR012413 | PF07886 | BA14K-like protein BA14k family |
| 27 | IPR005639 | PF03945 | delta endotoxin, N-terminal domain Pesticidal crystal protein, N-terminal |
| 28 | IPR036404 | SSF51101 | Jacalin-like lectin domain superfamily |
| 29 | IPR003610 | SM00495 | Carbohydrate-binding module family 5/12 |
| 30 | IPR013783 | G3DSA:2.60.40.10 | Immunoglobulin-like fold |
| 31 | IPR036573 | SSF51055 | Carbohydrate-binding module superfamily 5/12 |
| 32 | IPR014756 | SSF81296 | Immunoglobulin E-set |
| 33 | IPR004302 | PF03067 | Lytic polysaccharide mono-oxygenase, cellulose-degrading Cellulose/chitin-binding protein, N-terminal |
| 34 | IPR036116 | SSF49265 | Fibronectin type III superfamily |
| 35 | IPR003961 | SM00060 | Fibronectin type III |
| 36 | IPR028920 | PF15633 | HYD1 signature containing ADP-ribosyltransferase Tox-ART-HYD1 domain |
| 37 | IPR003540 | PF03496 | ADP-ribosyltransferase exoenzyme |
| 38 | IPR023828 | PS00138 | Serine proteases, subtilase family, serine active site. Peptidase S8, subtilisin, Ser-active site |
| 39 | IPR008964 | SSF49373 | Invasin/intimin cell-adhesion fragments |
| 40 | IPR024519 | PF11924 | Inverse autotransporter, beta-domain Inverse autotransporter, beta-domain |
| 41 | IPR038177 | G3DSA:2.40.160.160 | Inverse autotransporter, beta-domain superfamily |
| 42 | IPR003535 | PR01369 | Intimin signature Intimin/invasin bacterial adhesion mediator protein |
| 43 | IPR011049 | G3DSA:2.150.10.10 | Serralysin-like metalloprotease, C-terminal |
| 44 | IPR001343 | PF00353 | RTX calcium-binding nonapeptide repeat (4 copies) RTX calcium-binding nonapeptide repeat |
| 45 | IPR009003 | SSF50494 | Peptidase S1, PA clan |
| 46 | IPR034033 | cd04277 | ZnMc_serralysin_like Serralysin-like metallopeptidase domain |
| 47 | IPR024079 | G3DSA:3.40.390.10 | Metallopeptidase, catalytic domain superfamily |
| 48 | IPR006026 | SM00235 | Peptidase, metallopeptidase |
| 49 | IPR013858 | PF08548 | Peptidase M10 serralysin, C terminal |
| 50 | IPR003137 | PF02225 | PA domain |
| 51 | IPR026444 | TIGR04183 | Por_Secre_tail: Por secretion system C-terminal sorting domain |
| 52 | IPR027268 | G3DSA:1.10.390.10 | Peptidase M4/M1, CTD superfamily |
| 53 | IPR001842 | PF02128 | Fungalysin metallopeptidase (M36) Peptidase M36, fungalysin |
| 54 | IPR005181 | PF03629 | Carbohydrate esterase, sialic acid-specific acetylesterase Sialate O-acetylesterase domain |
| 55 | IPR036514 | G3DSA:3.40.50.1110 | SGNH hydrolase superfamily |
| 56 | IPR018003 | PF03538 | Salmonella virulence plasmid 28.1 kDa A protein Insecticidal toxin complex/plasmid virulence protein |

TABLE 13-continued

Details of Identified Domains

| Domain Identifier (ID) | InterPro number | Accession number in source database | Description of IPR |
|---|---|---|---|
| 57 | IPR029044 | SSF53448 | Nucleotide-diphospho-sugar transferases |
| 58 | IPR006311 | PS51318 | Twin arginine translocation (Tat) signal profile. Twin-arginine translocation pathway, signal sequence |
| 59 | IPR004991 | PF03318 | Clostridium epsilon toxin ETX/Bacillus mosquitocidal toxin MTX2 Aerolysin-like toxin |
| 60 | IPR000909 | SM00148 | Phosphatidylinositol-specific phospholipase C, X domain |
| 61 | IPR017946 | G3DSA:3.20.20.190 | PLC-like phosphodiesterase, TIM beta/alpha-barrel domain superfamily |
| 62 | IPR008708 | PF05616 | Neisseria meningitidis TspB protein TspB virulence factor |
| 63 | IPR010572 | PF06605 | Prophage endopeptidase tail Prophage tail endopeptidase |
| 64 | IPR007119 | TIGR01665 | put_anti_recept: phage minor structural protein, N-terminal region |
| 65 | IPR011889 | TIGR02167 | Liste_lipo_26: bacterial surface protein 26-residue repeat |
| 66 | IPR005046 | PF03382 | Mycoplasma protein of unknown function, DUF285 |
| 67 | IPR027994 | PF13731 | WxL domain surface cell wall-binding WxL domain |
| 68 | IPR008900 | PF05707 | Zonular occludens toxin (Zot) Zona occludens toxin |
| 69 | IPR010566 | PF06594 | Haemolysin-type calcium binding protein related domain Haemolysin-type calcium binding-related |
| 70 | IPR003995 | PR01488 | Gram-negative bacterial RTX toxin determinant A family signature RTX toxin determinant A |
| 71 | IPR008414 | PF05791 | Bacillus haemolytic enterotoxin (HBL) Hemolysin BL-binding component |
| 72 | IPR013320 | SSF49899 | Concanavalin A-like lectin/glucanase domain superfamily |
| 73 | IPR018511 | PS00330 | Hemolysin-type calcium-binding region signature. Hemolysin-type calcium-binding conserved site |
| 74 | IPR000757 | PF00722 | Glycosyl hydrolases family 16 |
| 75 | IPR036730 | G3DSA:2.170.14.10 | Phage P22 tailspike-like, N-terminal domain superfamily |
| 76 | IPR009093 | PF09008 | Head binding Bacteriophage P22 tailspike, N-terminal |
| 77 | IPR011083 | PF07484 | Phage Tail Collar Domain |
| 78 | IPR003959 | PF00004 | ATPase family associated with various cellular activities (AAA) ATPase, AAA-type, core |
| 79 | IPR027417 | SSF52540 | P-loop containing nucleoside triphosphate hydrolase |
| 80 | IPR025968 | PF14431 | YwqJ-like deaminase |
| 81 | IPR028897 | PF15656 | Toxin with a H, D/N and C signature Tox-HDC domain |
| 82 | IPR008638 | TIGR01901 | adhes_NPXG: filamentous hemagglutinin family N-terminal domain Filamentous haemagglutinin, N-terminal |
| 83 | IPR012334 | G3DSA:2.160.20.10 | Pectin lyase fold |
| 84 | IPR035918 | SSF55676 | Delta-endotoxin CytB-like superfamily |
| 85 | IPR024769 | PF12920 | TcdA/TcdB toxin, pore forming domain |
| 86 | IPR003730 | PF02578 | Multi-copper polyphenol oxidoreductase laccase Multi-copper polyphenol oxidoreductase |
| 87 | IPR011324 | SSF64438 | Cytotoxic necrotizing factor-like, catalytic |
| 88 | IPR038371 | G3DSA:3.60.140.10 | Multi-copper polyphenol oxidoreductase superfamily |
| 89 | IPR035992 | SSF50370 | Ricin B-like lectins |
| 90 | IPR000259 | PF00419 | Fimbrial protein Fimbrial-type adhesion domain |
| 91 | IPR036937 | G3DSA:2.60.40.1090 | Fimbrial-type adhesion domain superfamily |
| 92 | IPR005430 | PR01613 | *Escherichia coli* P pili tip fibrillum PapF protein signature |
| 93 | IPR008966 | SSF49401 | Adhesion domain superfamily |
| 94 | IPR004954 | PF03272 | Putative mucin or carbohydrate-binding module Putative mucin/carbohydrate-binding domain |
| 95 | IPR003344 | PF02369 | Bacterial Ig-like domain (group 1) Big-1 (bacterial Ig-like domain 1) domain |
| 96 | IPR012332 | G3DSA:2.160.20.20 | P22 tailspike-like, C-terminal domain superfamily |
| 97 | IPR029058 | SSF53474 | Alpha/Beta hydrolase fold |
| 98 | IPR003386 | PF02450 | Lecithin:cholesterol acyltransferase Lecithin:cholesterol/phospholipid:diacylglycerol acyltransferase |

TABLE 13-continued

Details of Identified Domains

| Domain Identifier (ID) | InterPro number | Accession number in source database | Description of IPR |
|---|---|---|---|
| 99 | IPR008872 | PF05431 | Insecticidal Crystal Toxin, P42 Insecticidal crystal toxin |
| 100 | IPR018337 | PS51170 | Cell wall-binding repeat profile. Cell wall/choline-binding repeat |
| 101 | IPR037149 | G3DSA:2.60.120.240 | Protective antigen, heptamerisation domain superfamily |
| 102 | IPR000772 | PS50231 | Lectin domain of ricin B chain profile. Ricin B, lectin domain |
| 103 | IPR035088 | PF03495 | Clostridial binary toxin B/anthrax toxin Protective antigen, Ca-binding domain |
| 104 | IPR003896 | PR01391 | Binary toxin B family signature Bacterial exotoxin B |
| 105 | IPR011658 | SM00758 | PA14 domain |
| 106 | IPR035331 | PF17476 | Clostridial binary toxin B/anthrax toxin Protective antigen domain 3 |
| 107 | IPR037524 | PS51820 | PA14 domain profile. PA14/GLEYA domain |
| 108 | IPR027439 | PF17475 | Clostridial binary toxin B/anthrax toxin Protective antigen, heptamerisation domain |
| 109 | IPR021862 | PF11958 | Domain of unknown function DUF3472 |

Example 4: Building of Monophyletic Groups

Twelve out of the 95 polynucleotides of the present invention are orthologues of 4 genes—ICM86 (SEQ ID NO:17), ICM147 (SEQ ID NO:24), ICM149 (SEQ ID NO:25) and ICM495 (SEQ ID NO: 62). The orthologues were identified by global identity search and further were predicted to retain similar protein structure and functionality, as indicated by conservation of their domain composition (Table 12). As shown in the validation experiments described in Examples 8-9 hereinbelow, these homologous genes exhibited insecticidal activity. These findings have led to the discovery of 4 protein families (monophyletic groups) with characteristic insecticidal activity, rather than a group of unrelated polynucleotides with incidental insecticidal attributes, even when some sequences in a family have a global sequence identity far less than 70% to each other.

Figure 1B:
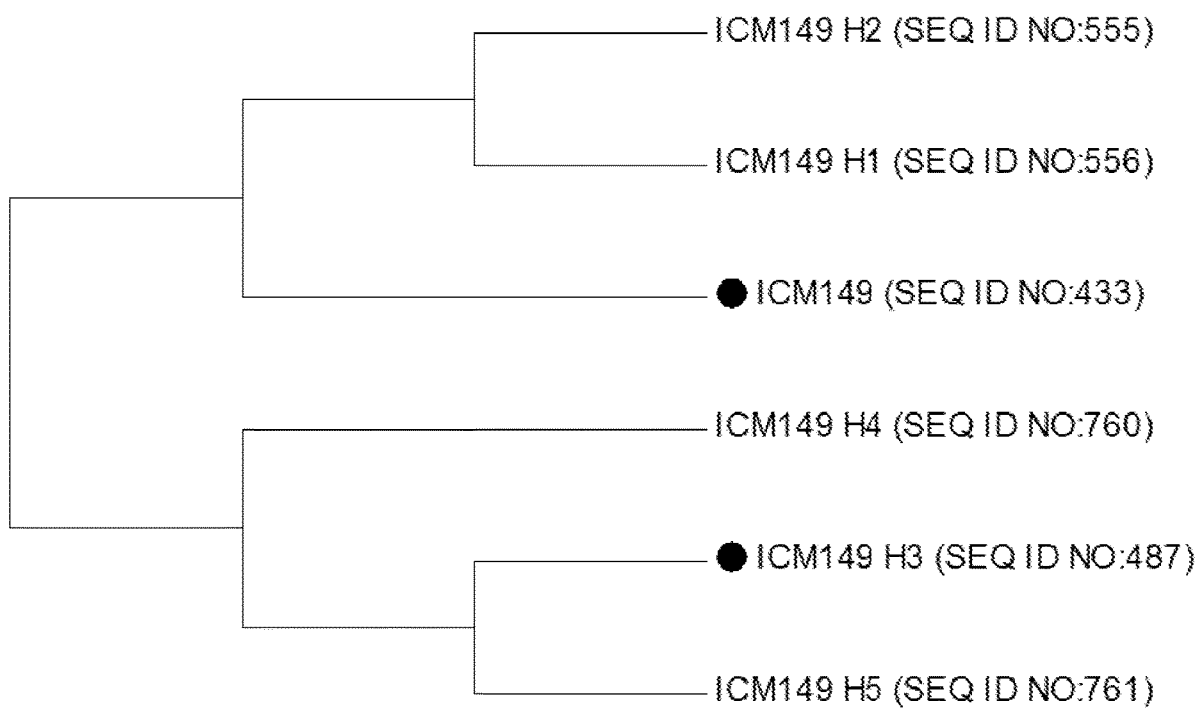
Figure 1C:
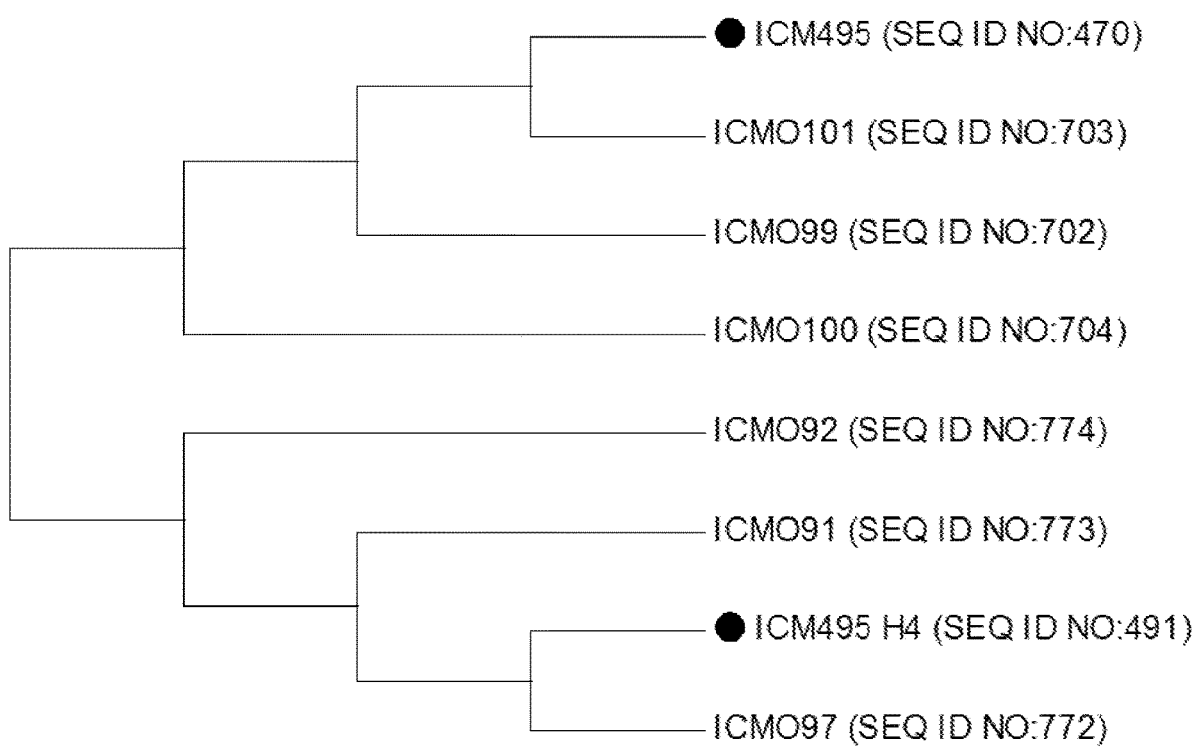
Figure 1D:
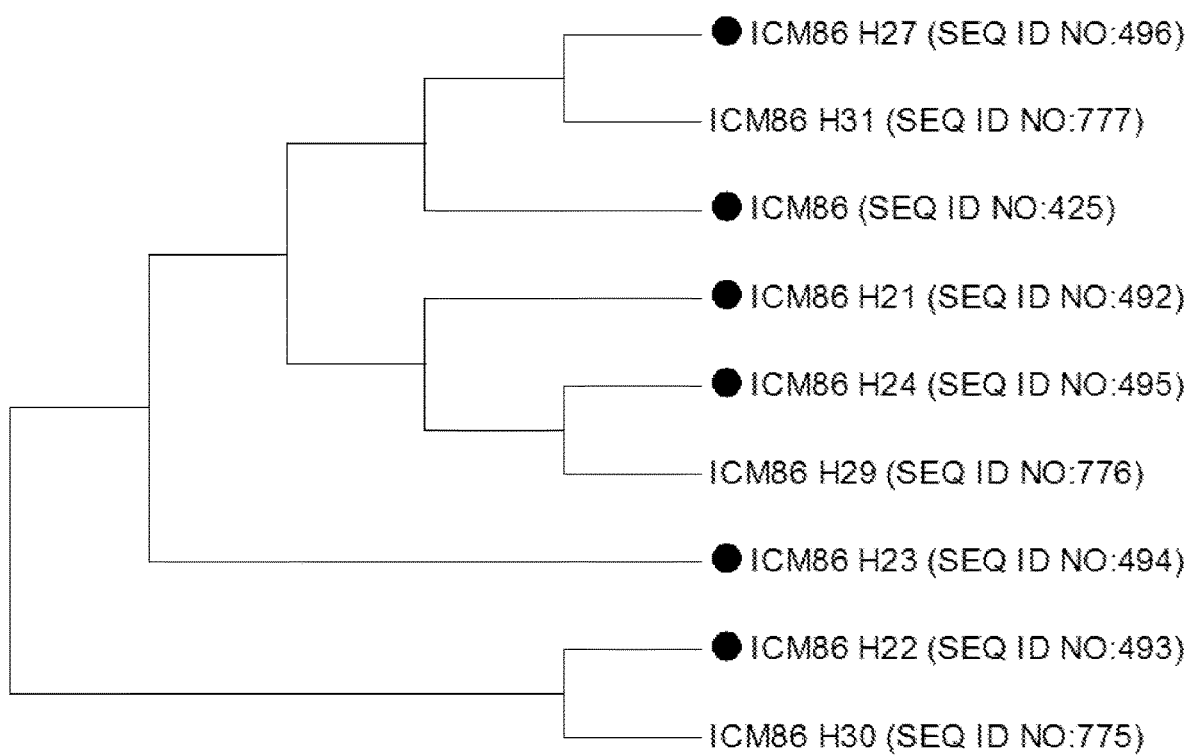
Figure 2:
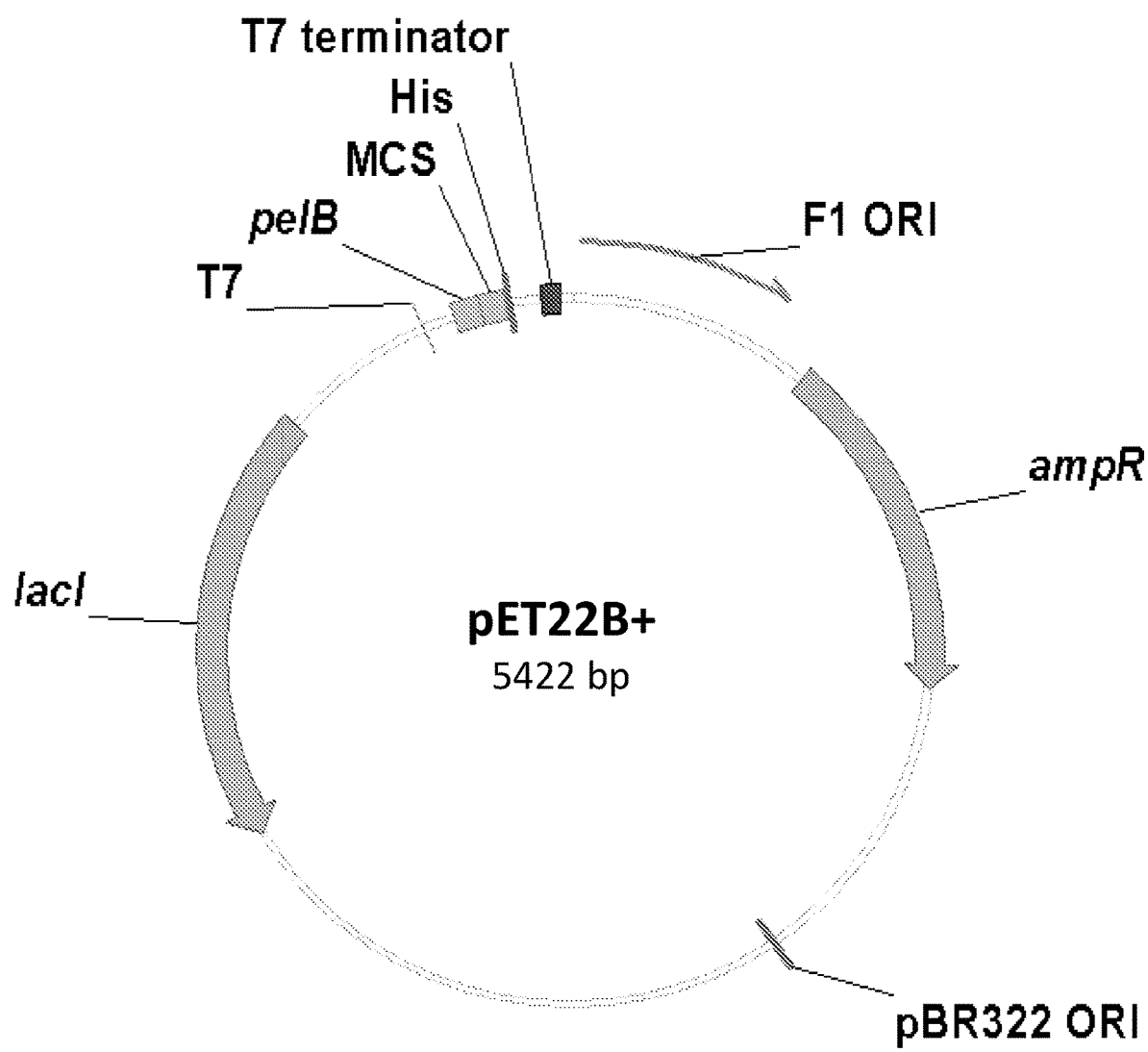
FIG. 2 is a schematic illustration of a nucleic acid construct according to some embodiments of the invention. Shown is the pET22b+ plasmid used for expressing the isolated polynucleotide sequence of some embodiments of the invention. T7=T7 promoter; pBR322 ORI=Origin of replication; His=His Tag coding sequence; pelB=N terminal pelB signal coding sequence; lacI=lacI repressor gene; ampR=ampicillin resistance gene. The isolated polynucleotide sequences according to some embodiments of the invention were cloned into the MCS (Multiple cloning site) of the vector.
Figure 3:
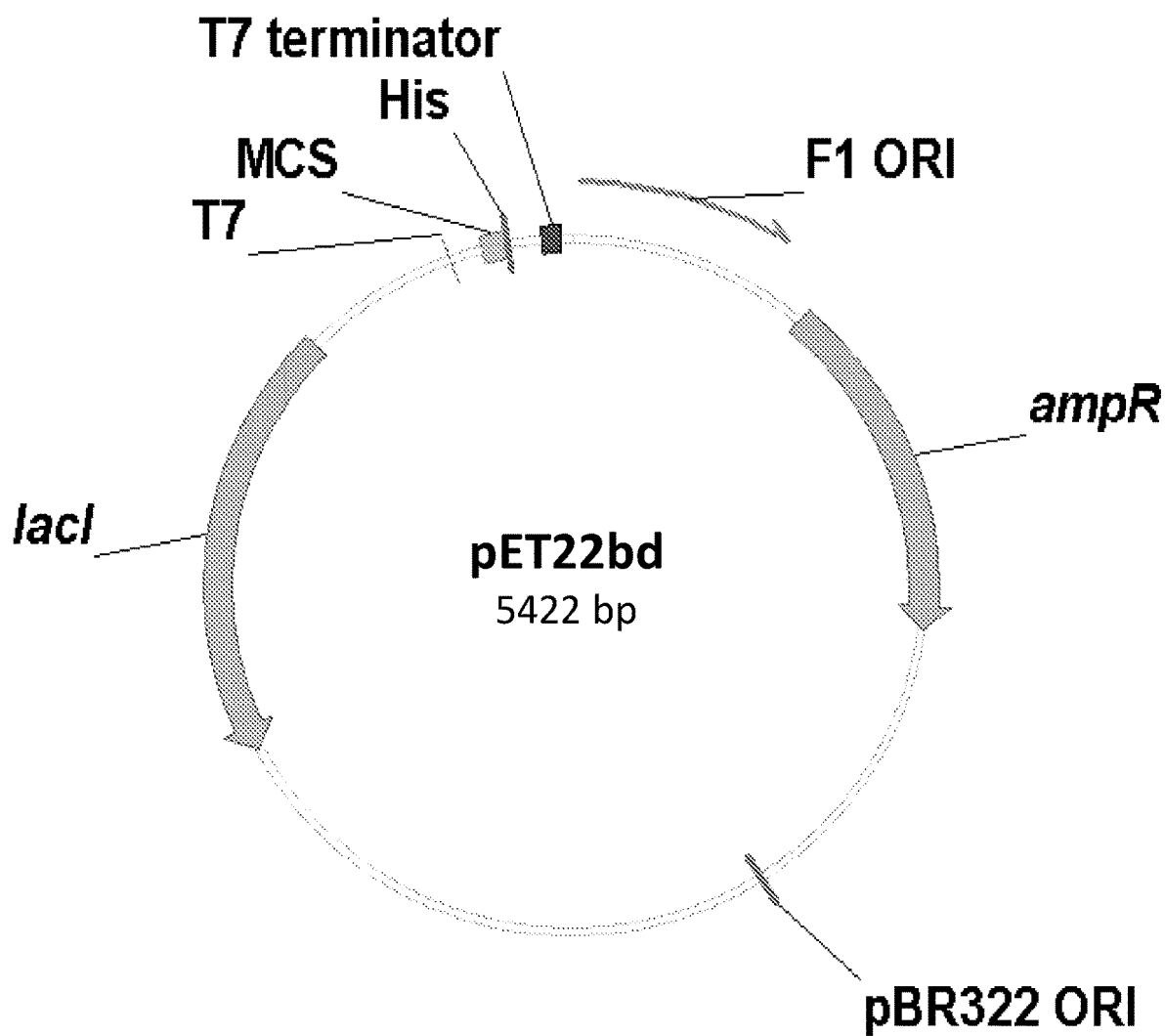
FIG. 3 is a schematic illustration of a nucleic acid construct according to some embodiments of the invention. Shown is the pET22bd plasmid used for expressing the isolated polynucleotide sequence of some embodiments of the invention. T7=T7 promoter; pBR322 ORI=Origin of replication; His=His Tag coding sequence; ampR=ampicillin resistance gene; lacI=lacI repressor gene. The isolated polynucleotide sequences according to some embodiments of the invention were cloned into the MCS (Multiple cloning site) of the vector.
Figure 4:
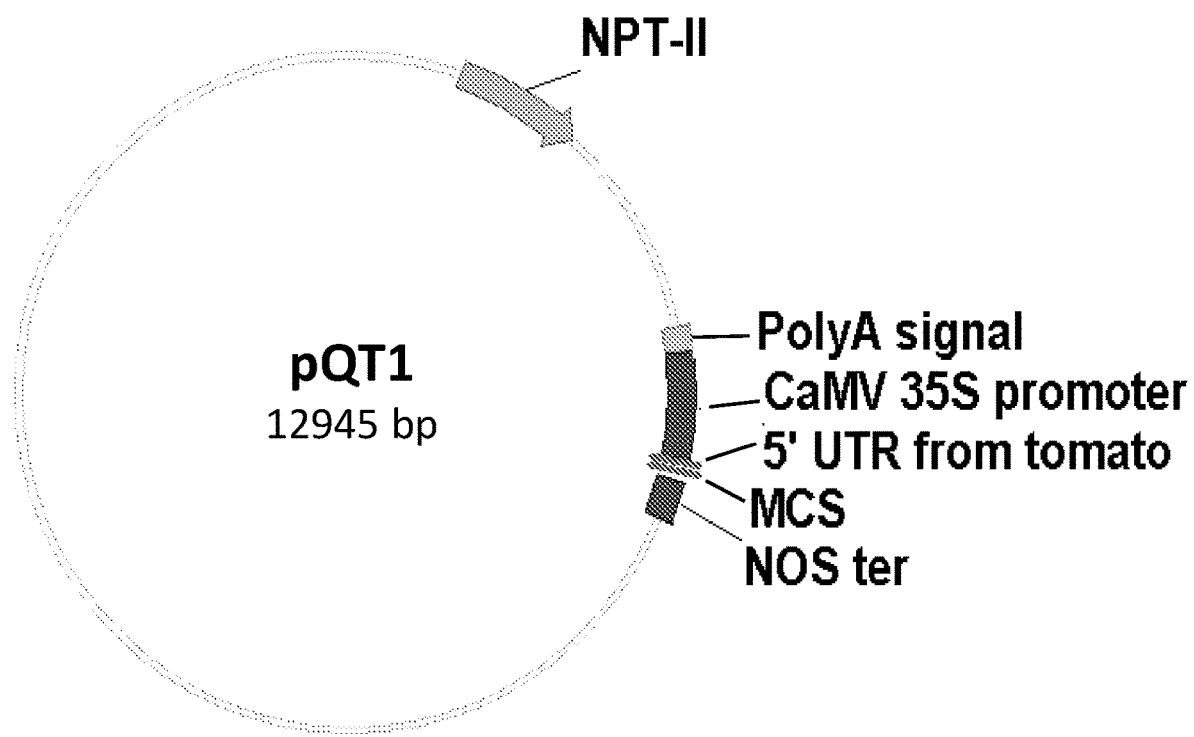
FIG. 4 is a schematic illustration of a nucleic acid construct according to some embodiments of the invention. Shown is the modified pQT1 binary plasmid containing the CaMV 35S promoter used for expressing the isolated polynucleotide sequence of some embodiments of the invention. NPT-II=neomycin phosphotransferase gene; NOS ter=nopaline synthase terminator; PolyA signal=polyadenylation signal; 5' UTR from tomato. The isolated polynucleotide sequences according to some embodiments of the invention were cloned into the MCS (Multiple cloning site) of the vector.
Figure 5:
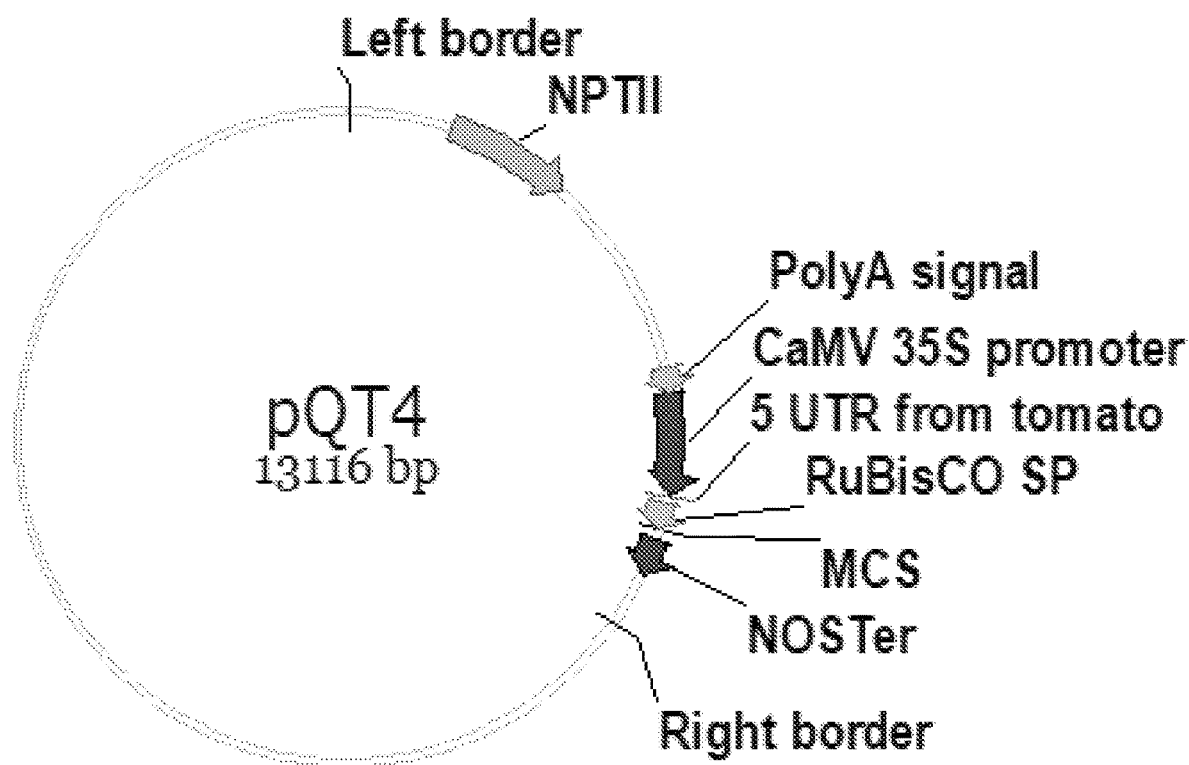
FIG. 5 is a schematic illustration of a nucleic acid construct according to some embodiments of the invention. Shown is the modified pQT4 binary plasmid containing the CaMV 35S promoter used for expressing the isolated polynucleotide sequence of the invention. Right border=T-DNA right border; Left border=T-DNA left border; NPT-II=neomycin phosphotransferase gene; NOS Ter=nopaline synthase terminator; PolyA signal=polyadenylation signal; 5' UTR from tomato; Rubisco SP=Rubisco signal peptide. The isolated polynucleotide sequences according to some embodiments of the invention were cloned into the MCS (Multiple cloning site) of the vector.
Figure 6:
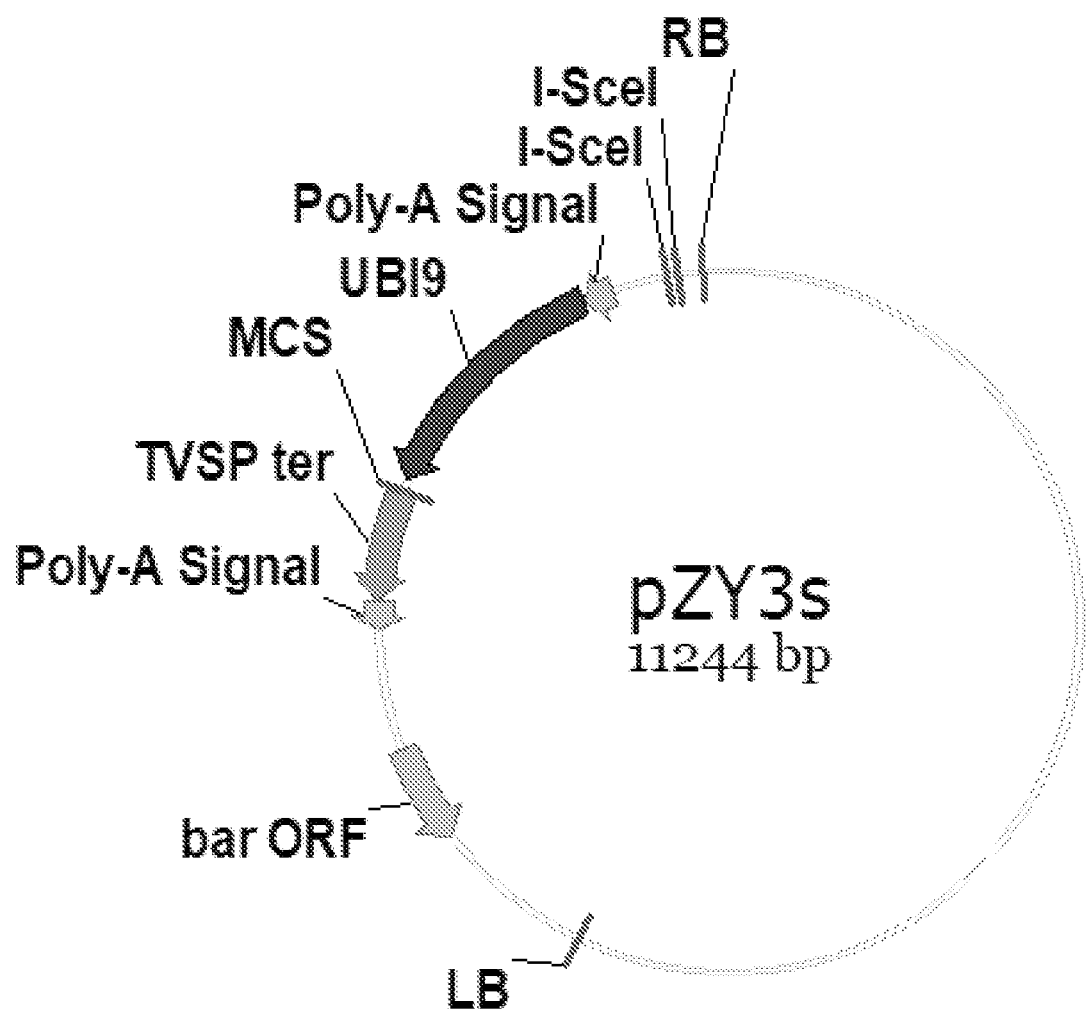
FIG. 6 is a schematic illustration of a nucleic acid construct according to some embodiments of the invention. Shown is the modified pZY3s binary plasmid containing the Ubiquitin9 (UBI9) promoter used for expressing the isolated polynucleotide sequence of the invention, and two I-SceI restriction sites to allow cloning of a 2nd expression cassette (with the same promoter and terminator) into the vector for stacking. RB=T-DNA right border; LB=T-DNA left border; bar ORF=Phosphinothricin N-acetyltransferase gene; TVSP ter=TVSP terminator. The isolated polynucleotide sequences according to some embodiments of the invention were cloned into the MCS (Multiple cloning site) of the vector.
Figure 7:
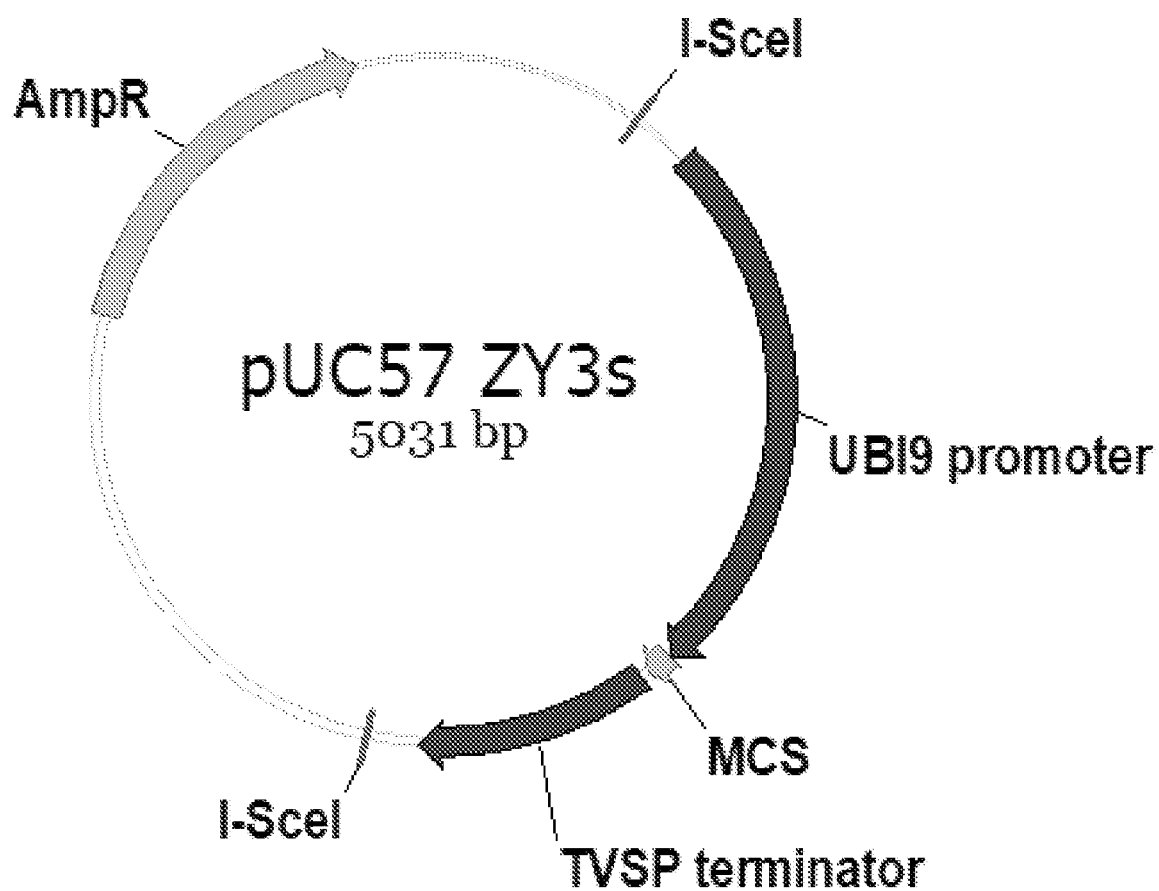
FIG. 7 is a schematic illustration of a nucleic acid construct according to some embodiments of the invention. Shown is the modified pUC57_ZY3s binary plasmid containing the Ubiquitin9 (UBI9) promoter used for expressing the isolated polynucleotide sequence of the invention, and TVSP ter=TVSP terminator, flanked by I-SceI restrictions sites for removal of the expression cassette for stacking. RB=T-DNA right border; LB=T-DNA left border; ampR=ampicillin resistance gene; The isolated polynucleotide sequences according to some embodiments of the invention were cloned into the MCS (Multiple cloning site) of the vector.
Figure 8:
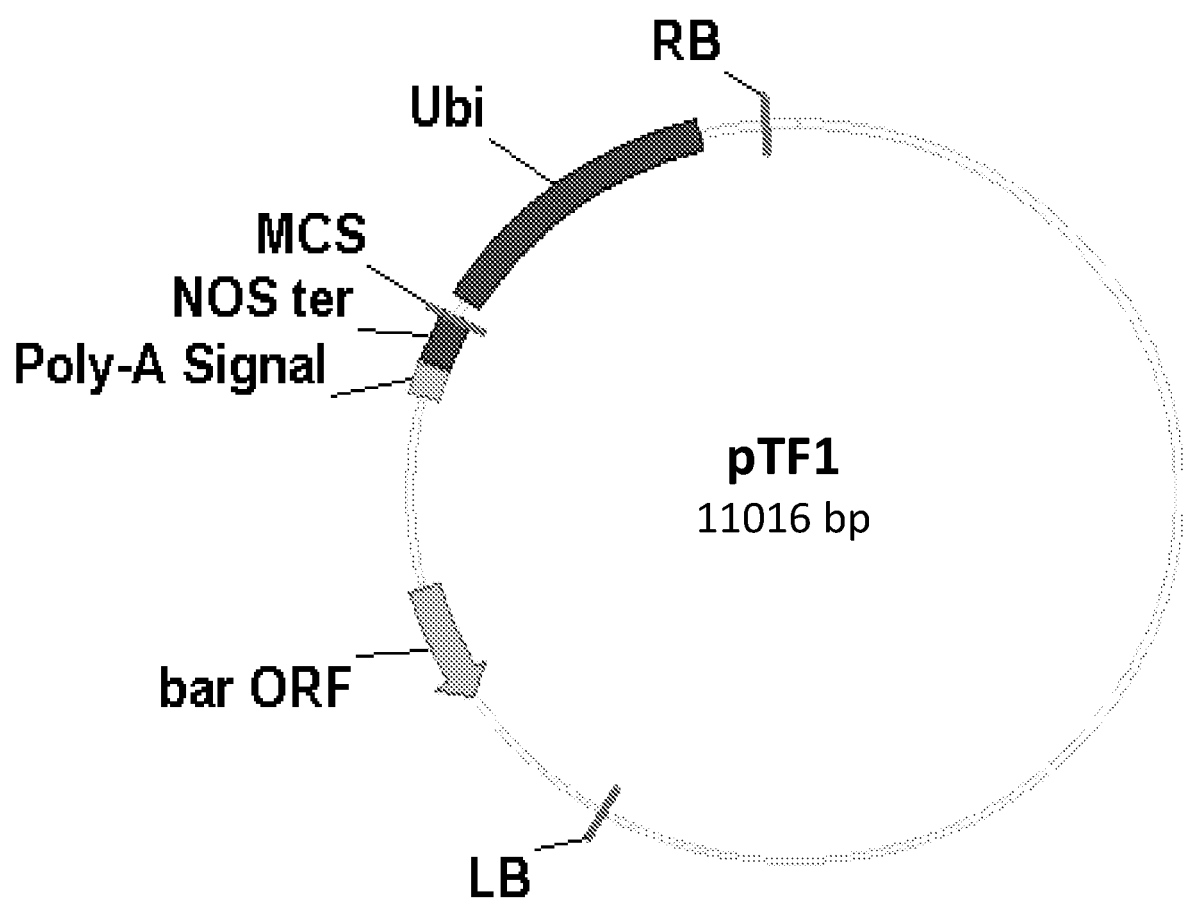
FIG. 8 is a schematic illustration of a nucleic acid construct according to some embodiments of the invention. Shown is the modified pTF1 binary plasmid containing the Maize Ubiquitin promoter (Ubi) used for expressing the isolated polynucleotide sequences of the invention. RB—T-DNA right border; LB—T-DNA left border; bar ORF=Phosphinothricin N-acetyltransferase gene; NOS ter=nopaline synthase terminator; Poly-A signal (polyadenylation signal). The isolated polynucleotide sequences according to some embodiments of the invention were cloned into the MCS (Multiple cloning site) of the vector.
Figure 9:
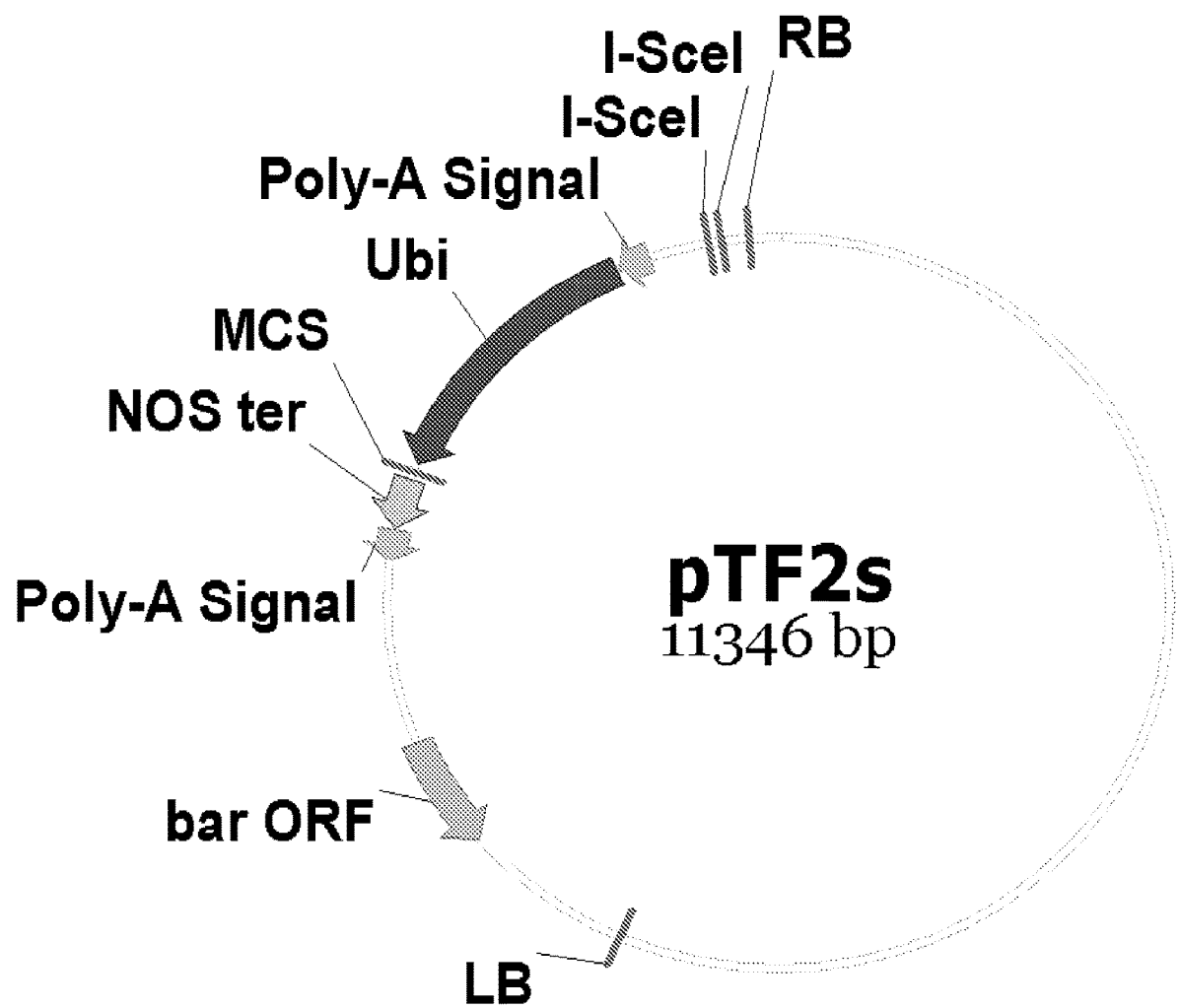
FIG. 9 is a schematic illustration of a nucleic acid construct according to some embodiments of the invention. Shown is the modified pTF2s binary plasmid containing the Maize Ubiquitin promoter (Ubi) used for expressing the isolated polynucleotide sequences of the invention. pTF2s contains two I-SceI restriction sites to allow cloning of a 2nd expression cassette into the vector for stacking. RB=T-DNA right border; LB=T-DNA left border; bar ORF=Phosphinothricin N-acetyltransferase gene; NOS ter=nopaline synthase terminator; Poly-A signal (polyadenylation signal). The isolated polynucleotide sequences according to some embodiments of the invention were cloned into the MCS (Multiple cloning site) of the vector.
Figure 10:
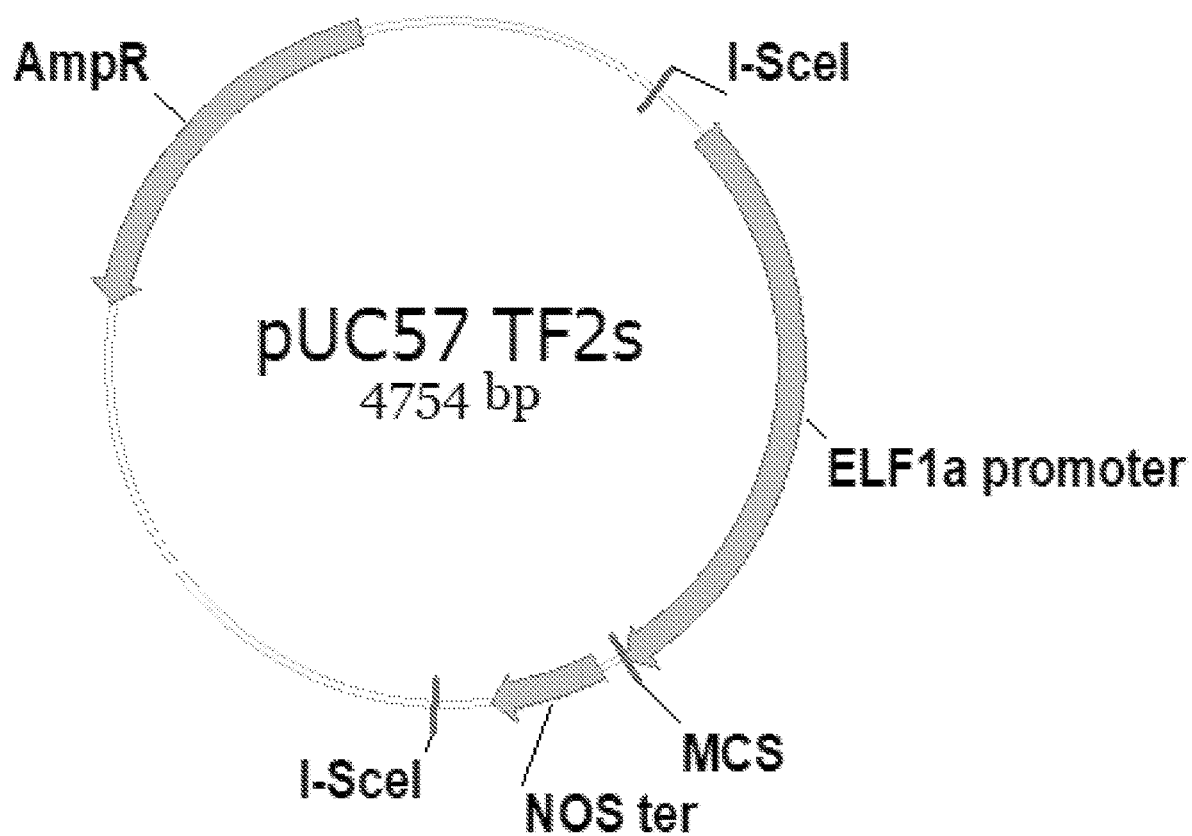
FIG. 10 is a schematic illustration of a nucleic acid construct according to some embodiments of the invention. Shown is the modified pUC57_TF2s binary plasmid containing the ELF1a promoter used for expressing the isolated polynucleotide sequence of the invention, and TVSP ter=TVSP terminator, flanked by I-SceI restrictions sites for removal of the expression cassette for stacking. RB=T-DNA right border; LB=T-DNA left border; ampR=ampicillin resistance gene. The isolated polynucleotide sequences according to some embodiments of the invention were cloned into the MCS (Multiple cloning site) of the vector.

These monophyletic groups were further depicted in FIGS. 1A-D as evolutionary trees composed of each of these 4 genes, their active orthologues and genes included in the 70% global identity space of each. These trees, which were generated by MEGA7 software [Molecular Evolutionary Genetics Analysis, version 7.0 (Kumar S, Stecher G, and Tamura K., 2016, "MEGA7: Molecular Evolutionary Genetics Analysis version 7.0 for bigger datasets". Molecular Biology and Evolution 33:1870-1874)] and the neighbor joining statistical model [(created by Naruya Saitou and Masatoshi Nei. "The neighbor-joining method: a new method for reconstructing phylogenetic trees." Molecular Biology and Evolution, volume 4, issue 4, pp. 406-425, July 1987), using default parameters, demonstrate the evolutionary relationship between the different amino acid sequences and the retention of insecticidal activity across the tree. Based on that, sequences which are not explicitly included in the sequence listing of this application, yet cluster in a monophyletic manner in one of those trees using the above-mentioned methodology instead of forming outgroups, and exhibit insecticidal activity, are to be considered members of one of the 4 protein families, regardless of their global sequence identity to any of the sequences in the sequence listing.

Tables 14-24 below list the members of the 4 monophyletic groups, the sequence identity and similarity between them, and the shared domains among the core genes of each monophyletic group.

TABLE 14

Monophyletic group I: ICM147 Family (Global Identity; Global Similarity) of SEQ ID NOs: 432, 482-486, 547-552

| SEQ ID NO | 432 | 482 | 483 | 484 | 485 | 486 | 547 | 548 | 549 | 550 | 551 | 552 |
|---|---|---|---|---|---|---|---|---|---|---|---|---|
| 432 | 100; 100 | 58.9; 82.9 | 23.4; 47.2 | 23.7; 47.5 | 23; 46.8 | 22.3; 45.2 | 99.8; 100 | 98.7; 98.8 | 97.7; 98.1 | 79.2; 91.1 | 77.7; 90.2 | 76.7; 89.6 |
| 482 | 58.9; 82.9 | 100; 100 | 22.2; 45.2 | 23.2; 47.7 | 22.7; 47.1 | 21.7; 46.9 | 58.7; 82.9 | 57.8; 82 | 57.1; 81.6 | 71.5; 87.9 | 71.2; 88.6 | 74.9; 90.5 |
| 483 | 23.4; 47.2 | 22.6; 44.6 | 100; 100 | 80.4; 92.8 | 93.1; 98.2 | 93.8; 98.9 | 23.3; 47.2 | 24.5; 48.7 | 25; 49.3 | 23.3; 46 | 22.9; 45.2 | 22.6; 46.8 |
| 484 | 23.7; 47.5 | 23.2; 47.7 | 80.4; 92.8 | 100; 100 | 80.3; 92.6 | 78.8; 92.3 | 23.6; 47.5 | 24.8; 48.2 | 25.4; 48.8 | 23.1; 47.2 | 22.9; 46.8 | 22.3; 45.3 |
| 485 | 22.6; 46.9 | 22.7; 47.1 | 93.1; 98.2 | 80.3; 92.6 | 100; 100 | 92.9; 98 | 22.5; 46.8 | 23.6; 48.3 | 24.2; 49 | 23.1; 45.6 | 23.6; 47.1 | 22.2; 46.4 |
| 486 | 22.3; 45.2 | 21.7; 46.9 | 93.8; 98.9 | 78.8; 92.3 | 92.9; 98 | 100; 100 | 22.2; 45.2 | 23.4; 46 | 23.9; 46.6 | 23; 45.7 | 22.6; 46.7 | 21.7; 45.8 |
| 547 | 99.8; 100 | 58.7; 82.9 | 23.3; 47.2 | 23.6; 47.5 | 22.9; 46.8 | 22.2; 45.2 | 100; 100 | 98.5; 98.8 | 97.9; 98.1 | 79; 91.1 | 77.5; 90.2 | 76.5; 89.6 |
| 548 | 98.7; 98.8 | 57.8; 82 | 24.5; 48.7 | 24.8; 48.2 | 24; 48.3 | 23.4; 46 | 98.5; 98.8 | 100; 100 | 99; 99.2 | 77.8; 90 | 76.3; 89 | 75.3; 88.4 |
| 549 | 97.7; 98.1 | 57.1; 81.6 | 25; 49.3 | 25.4; 48.8 | 24.6; 48.9 | 23.9; 46.6 | 97.9; 98.1 | 99; 99.2 | 100; 100 | 76.9; 89.2 | 75.4; 88.3 | 74.4; 87.7 |
| 550 | 79.2; 91.1 | 71.5; 87.9 | 23.3; 46 | 23.1; 47.2 | 23.1; 45.6 | 23; 45.7 | 79; 91.1 | 77.8; 90 | 76.9; 89.2 | 100; 100 | 85.6; 94.4 | 83.1; 92.2 |
| 551 | 77.7; 90.2 | 71.2; 88.6 | 22.9; 44.7 | 23.1; 47.7 | 23.6; 47.1 | 23.3; 48.8 | 77.5; 90.2 | 76.3; 89 | 75.4; 88.3 | 85.6; 94.4 | 100; 100 | 83.8; 91.7 |
| 552 | 76.7; 89.6 | 74.9; 90.5 | 22.6; 46.8 | 22.5; 46.2 | 22.2; 46.4 | 21.7; 45.8 | 76.5; 89.6 | 75.3; 88.4 | 74.4; 87.7 | 83.1; 92.2 | 83.8; 91.7 | 100; 100 |
| 553 | 73.1; 85.1 | 67.8; 83.6 | 24.2; 47.8 | 24.8; 49.4 | 25.7; 50.3 | 25.2; 50.6 | 72.9; 85.1 | 72.2; 84.4 | 71.5; 83.8 | 80.7; 89.1 | 93.5; 93.5 | 79.2; 86.5 |
| 554 | 70.6; 86.7 | 77.6; 89.5 | 21.9; 45.9 | 23; 46.4 | 21.6; 46 | 21.5; 46.9 | 70.6; 86.7 | 69.3; 85.6 | 68.9; 85 | 80.1; 90 | 85.6; 92.8 | 80.9; 90.9 |
| 725 | 50.9; 75.1 | 73.5; 83.1 | 18.6; 38.5 | 18.6; 39.4 | 19.1; 39.1 | 19; 39.4 | 50.9; 75.1 | 49.7; 74.1 | 49.4; 73.8 | 58.6; 75.7 | 59.2; 78.5 | 59.2; 78.5 |

TABLE 14-continued

Monophyletic group I: ICM147 Family (Global Identity; Global Similarity) of SEQ ID NOs: 432, 482-486, 547-552

| SEQ ID NO | 432 | 482 | 483 | 484 | 485 | 486 | 547 | 548 | 549 | 550 | 551 | 552 |
|---|---|---|---|---|---|---|---|---|---|---|---|---|
| 726 | 23.3; 47.2 | 22.4; 44.6 | 99.8; 99.8 | 80.2; 92.6 | 92.9; 98 | 93.7; 98.7 | 23.2; 47.2 | 24.3; 48.7 | 24.9; 49.3 | 23.2; 46 | 22.8; 45.2 | 22.5; 46.8 |
| 727 | 23.2; 47.4 | 22.5; 44.8 | 98.7; 98.7 | 79.3; 91.6 | 92; 96.9 | 92.8; 97.6 | 23.1; 47.4 | 24.3; 48.9 | 24.8; 49.5 | 23.3; 46.2 | 22.8; 45.4 | 22.5; 47 |
| 728 | 22.8; 44.7 | 22.3; 45.2 | 96.7; 99.5 | 80.3; 92.8 | 95.7; 98.7 | 96.6; 99.5 | 22.7; 44.6 | 23.8; 46.1 | 24.4; 46.7 | 23.9; 45.5 | 22.7; 44.7 | 22.3; 44.5 |
| 729 | 22.6; 44.8 | 22.3; 46.6 | 95.7; 98.9 | 80.6; 93 | 96.7; 99.3 | 95.5; 98.7 | 22.6; 44.8 | 23.7; 46.2 | 24.2; 46.9 | 23.5; 45.5 | 23.8; 46.9 | 22.6; 46.9 |
| 730 | 23; 46.7 | 22.9; 46.8 | 94.6; 98.7 | 79.7; 93 | 97.6; 99.5 | 94.8; 98.6 | 22.9; 46.7 | 24; 48.2 | 24.6; 48.8 | 23.9; 45.5 | 23.3; 44.7 | 22.4; 46.7 |
| 731 | 22.7; 45.3 | 21.9; 45.4 | 93.8; 99.1 | 79.4; 93.2 | 93.1; 98.6 | 97.1; 99.5 | 22.6; 45.2 | 23.8; 46 | 24.3; 46.7 | 23.5; 46.4 | 22.8; 45.2 | 22; 45.3 |
| 732 | 23; 46.9 | 22.6; 46.7 | 92.9; 98.6 | 79.5; 93.2 | 97.1; 99.1 | 93.1; 98.6 | 22.9; 46.9 | 24; 48.3 | 24.6; 49 | 23.1; 46.9 | 23.7; 47.5 | 22; 47.3 |
| 733 | 23; 44.5 | 22.7; 47.4 | 90.4; 96.9 | 84.7; 94.8 | 91.5; 97.7 | 89.7; 96.9 | 22.9; 44.5 | 24.1; 45.3 | 24.7; 45.9 | 23.2; 46.9 | 23.5; 47.2 | 22.5; 47.2 |
| 734 | 23.8; 47.9 | 22.3; 46.9 | 88.3; 94.8 | 89.3; 96.4 | 88.6; 95.5 | 86.3; 94.6 | 23.7; 47.9 | 24.9; 48.7 | 25.5; 49.4 | 23.2; 47.7 | 23.5; 44.7 | 22; 46.1 |
| 735 | 23.1; 46.6 | 22; 45.8 | 85.6; 95.9 | 80.4; 92.5 | 86.5; 96 | 84.5; 95.3 | 23; 46.6 | 24.2; 47.4 | 24.7; 48 | 22.8; 47.9 | 23.6; 47 | 21.6; 49.1 |
| 736 | 22.5; 47.3 | 22.2; 45.6 | 84.6; 94.6 | 83.3; 94.9 | 84.1; 94.4 | 82.8; 94 | 22.5; 47.3 | 23.7; 48.1 | 24.2; 48.7 | 23.5; 47.9 | 22.9; 47.3 | 21.9; 44.8 |
| 737 | 23.3; 49.5 | 21.5; 45.9 | 82.1; 93.5 | 79.5; 93.7 | 81.5; 93.8 | 81.2; 93.5 | 23.2; 49.5 | 24.4; 50.3 | 25; 51 | 24.5; 48 | 23.3; 48.7 | 23.1; 48.3 |
| 738 | 23; 48.3 | 21.6; 45.7 | 81.4; 92.3 | 79.5; 93.2 | 80.8; 91.6 | 80.4; 92.1 | 23; 48.3 | 24.2; 49.1 | 24.7; 49.8 | 24; 46.9 | 23.2; 47 | 21.7; 45.4 |
| 739 | 23.2; 47.7 | 23; 47.5 | 80.4; 92.6 | 99.3; 100 | 80.3; 92.6 | 78.8; 92.1 | 23.1; 47.7 | 24.3; 48.3 | 24.9; 49 | 22.4; 47.5 | 22.9; 46.8 | 22.7; 45 |
| 740 | 25.3; 47.7 | 23.6; 46.9 | 79.5; 94.2 | 79; 93.5 | 79.7; 93.8 | 78.1; 93.8 | 25.2; 47.7 | 25.9; 48.2 | 26.5; 48.8 | 24.6; 47.6 | 24; 49.2 | 22.4; 47.7 |
| 741 | 23.1; 46.5 | 22.6; 45.4 | 77.6; 80.4 | 64.8; 76.3 | 76.7; 79.6 | 78; 80.5 | 23; 46.5 | 24; 47.8 | 24.5; 48.4 | 24.4; 46.4 | 22.1; 42.6 | 21.2; 48.1 |
| 742 | 22.4; 46.9 | 22.7; 45.9 | 76.9; 89.3 | 77.3; 91.5 | 76.6; 90 | 76.2; 89.1 | 22.3; 46.8 | 23.6; 48.2 | 24.2; 48.8 | 22.6; 45.7 | 23.1; 46.7 | 22.3; 47.1 |
| 743 | 23.5; 48.8 | 24.1; 48.2 | 76.4; 89.6 | 76.4; 89.6 | 76.4; 89.8 | 75.9; 89.6 | 23.5; 48.8 | 24.6; 49.6 | 25.2; 50.2 | 24.9; 48.9 | 23.5; 47.2 | 23.6; 47.8 |
| 744 | 24; 48.4 | 23.4; 48.3 | 75; 90 | 74.5; 89.6 | 75.1; 90 | 74.4; 89.6 | 23.9; 48.4 | 24.9; 49.2 | 25.3; 49.8 | 24.8; 49.1 | 24.5; 48.4 | 23; 46.1 |
| 745 | 27.3; 54.5 | 26; 59.9 | 70.5; 72.5 | 60.7; 68.7 | 70.1; 72.4 | 70.7; 72.6 | 27.5; 54.5 | 28.4; 55.4 | 29.1; 55.8 | 28.4; 56.3 | 28.3; 57.5 | 26.4; 58.3 |
| 746 | 23.7; 47.7 | 23.4; 47.7 | 79.9; 92.6 | 99.5; 99.8 | 79.7; 92.5 | 78.3; 92.1 | 23.6; 47.7 | 24.8; 48.3 | 25.4; 49 | 23.1; 47.4 | 22.9; 46.8 | 22.3; 45.3 |
| 747 | 24.1; 47.8 | 22.5; 47 3 | 88.6; 96.4 | 87.5; 95.7 | 89; 96.7 | 86.6; 96 | 24; 47.8 | 25.2; 48.6 | 25.8; 49.2 | 24.3; 47.3 | 23.3; 44 | 22.5; 46.6 |
| 748 | 23.6; 47.1 | 21.8; 46.1 | 85.5; 95.8 | 83.7; 94.9 | 85.3; 96 | 83.7; 95.3 | 23.6; 47.1 | 24.7; 47.9 | 25.3; 48.5 | 25; 48.3 | 23.1; 47.3 | 22.6; 46.8 |
| 749 | 23.3; 47.3 | 22; 47.1 | 85; 94.9 | 82.4; 95.5 | 83.9; 94.6 | 83.5; 94.9 | 23.2; 47.3 | 24.4; 48 | 25; 48.7 | 22.9; 46.6 | 23.5; 45.3 | 22.3; 47 |
| 750 | 23.5; 48.8 | 22.5; 46.6 | 79.2; 93.3 | 79.9; 92.6 | 78.8; 93.1 | 77.9; 92.9 | 23.4; 48.8 | 24.6; 49.6 | 25.2; 50.2 | 24.6; 47.6 | 23.6; 48.4 | 22.9; 48.1 |
| 751 | 22.6; 45.4 | 22.2; 45.6 | 92.2; 98.6 | 78.3; 92.1 | 90.9; 97.6 | 95.5; 99.3 | 22.5; 45.4 | 23.6; 46.2 | 24.2; 46.8 | 24.1; 46.2 | 22.8; 45.7 | 21.8; 45.6 |
| 752 | 23.9; 46.4 | 23.1; 50.2 | 85.6; 88.4 | 71.7; 83.8 | 84.6; 87.5 | 86.3; 88.5 | 23.8; 46.4 | 24.9; 47.8 | 25.4; 48.4 | 24.6; 47.8 | 24.5; 48.2 | 23; 48.9 |
| 753 | 22.4; 43.9 | 22.6; 46.9 | 93.7; 98.9 | 79.8; 93.9 | 97.8; 99.6 | 93.7; 98.6 | 22.3; 43.9 | 23.5; 45.3 | 24; 46 | 23.9; 45.4 | 23.1; 47.7 | 22.1; 47.2 |
| 754 | 22.5; 43.6 | 22.1; 46.4 | 94.4; 98.4 | 79.3; 93.5 | 95.8; 98.9 | 93.8; 98 | 22.4; 43.6 | 23.5; 45.1 | 24.1; 45.7 | 22.4; 48.7 | 22.9; 47.3 | 21.8; 45.9 |
| 755 | 23.1; 47.6 | 20.9; 48.2 | 69.4; 90 | 68.8; 89.2 | 70.1; 89.9 | 68.5; 89.7 | 23.2; 47.6 | 23.9; 48.2 | 24.3; 48.7 | 23.3; 49.9 | 23.8; 47.4 | 21.2; 46.8 |
| 756 | 23.1; 45 | 22.3; 45.2 | 96.4; 99.1 | 80.3; 93 | 95.5; 98.6 | 96.7; 99.6 | 23; 45 | 24.1; 46.4 | 24.7; 47 | 23.9; 45.5 | 23; 44.1 | 22.5; 46.6 |
| 757 | 22.6; 44.8 | 22.2; 45.7 | 96.2; 99.6 | 80; 93.2 | 92.8; 98.2 | 92.8; 99.1 | 22.5; 44.8 | 23.6; 46.2 | 24.2; 46.8 | 23.3; 47.3 | 23.5; 44.8 | 22.3; 46.6 |
| 758 | 24.1; 47.5 | 20.8; 47 | 80.4; 92.9 | 78.2; 93.1 | 80.3; 93.1 | 79.7; 93.5 | 24.1; 47.5 | 25.2; 48.3 | 25.6; 48.9 | 24.6; 48.4 | 23.2; 47.7 | 22.3; 47.6 |
| 759 | 23.8; 47.7 | 22.6; 45.8 | 75.9; 78.6 | 63.4; 74.6 | 75; 77.9 | 76.3; 78.7 | 23.8; 47.6 | 24.8; 49 | 25.3; 49.5 | 26; 48 | 22.8; 44.5 | 21.6; 49.1 |

TABLE 15

Monophyletic group I: ICM147 Family (Global Identity; Global Similarity) of SEQ ID Nos 553-554, 725-734

| SEQ ID NO | 553 | 554 | 725 | 726 | 727 | 728 | 729 | 730 | 731 | 732 | 733 | 734 |
|---|---|---|---|---|---|---|---|---|---|---|---|---|
| 432 | 73.1; 85.1 | 70.6; 86.7 | 50.9; 75.1 | 23.3; 47.2 | 23.2; 47.4 | 22.8; 44.7 | 22.6; 44.8 | 23; 46.7 | 22.7; 45.3 | 23; 46.9 | 23.2; 45.1 | 23.8; 47.9 |
| 482 | 67.8; 83.6 | 77.6; 89.5 | 73.5; 83.1 | 22.1; 45.2 | 22.1; 45.4 | 22.3; 45.2 | 22.3; 46.6 | 22.9; 46.8 | 21.9; 45.4 | 22.6; 46.7 | 22.7; 47.4 | 22.3; 46.9 |
| 483 | 24.2; 48.3 | 21.9; 45.2 | 18.6; 38.5 | 99.8; 99.8 | 98.7; 98.7 | 96.7; 99.5 | 95.7; 98.9 | 94.6; 98.7 | 93.8; 99.1 | 92.9; 98.6 | 90.4; 96.9 | 88.3; 94.8 |
| 484 | 24.8; 49.4 | 22.8; 45.5 | 18.6; 39.4 | 80.2; 92.6 | 79.3; 91.6 | 80.3; 92.8 | 80.6; 93 | 79.7; 93 | 79.4; 93.2 | 79.5; 93.2 | 84.7; 94.8 | 89.3; 96.4 |
| 485 | 25.7; 50.3 | 21.6; 46 | 19.1; 39.1 | 92.9; 98 | 92; 96.9 | 95.7; 98.7 | 96.7; 99.3 | 97.6; 99.5 | 93.1; 98.6 | 97.1; 99.1 | 91.5; 97.7 | 88.6; 95.5 |
| 486 | 24.5; 48.5 | 21.5; 46.9 | 19; 39.4 | 93.7; 98.7 | 92.8; 97.6 | 96.6; 99.5 | 95.5; 98.7 | 94.8; 98.6 | 97.1; 99.5 | 93.1; 98.6 | 89.7; 96.9 | 86.3; 94.6 |
| 547 | 72.9; 85.1 | 70.6; 86.7 | 50.9; 76.7 | 23.2; 47.2 | 23.1; 47.4 | 22.7; 44.8 | 22.6; 44.8 | 22.9; 46.7 | 22.6; 45.2 | 22.9; 46.9 | 23.1; 45.1 | 23.7; 47.9 |
| 548 | 72.2; 84.4 | 69.3; 85.6 | 49.7; 74.1 | 24.3; 48.7 | 24.3; 48.9 | 23.8; 46.1 | 23.7; 46.2 | 24; 48.2 | 23.8; 46 | 24; 48.3 | 24.3; 45.9 | 24.9; 48.7 |
| 549 | 71.5; 83.8 | 68.9; 85 | 49.4; 73.8 | 24.9; 49.3 | 24.8; 49.5 | 24.4; 46.7 | 24.2; 46.9 | 24.6; 48.8 | 24.3; 46.7 | 24.6; 49 | 24.8; 46.5 | 25.5; 49.4 |
| 550 | 80.7; 89.1 | 80.1; 90 | 58.6; 75.7 | 23.2; 46 | 23.3; 46.2 | 23.9; 45.5 | 23.5; 45.5 | 23.9; 45.5 | 23.5; 46.4 | 23.1; 46.9 | 23.4; 47.9 | 23.4; 48.6 |
| 551 | 93.5; 93.5 | 85.6; 92.8 | 59.2; 78.5 | 22.7; 44.7 | 22.8; 44.8 | 22.7; 44.7 | 23.8; 46.9 | 23.3; 44.7 | 22.8; 45.2 | 23.7; 47.5 | 23.7; 48.2 | 23.7; 45.6 |
| 552 | 79.2; 86.5 | 80.9; 90.9 | 59.2; 78.5 | 22.5; 46.8 | 22.5; 47 | 22.3; 44.5 | 22.6; 46.9 | 22.4; 46.7 | 22; 45.3 | 22; 47.3 | 22.7; 48.1 | 22.2; 47 |
| 553 | 100; 100 | 81.4; 87.5 | 56.3; 73.9 | 24; 47.6 | 24; 47 | 24.4; 47.9 | 26; 50.2 | 25.7; 47.8 | 24.5; 47.8 | 26; 50.7 | 25.7; 50.1 | 25.5; 47.3 |
| 554 | 81.4; 87.5 | 100; 100 | 67.9; 81 | 21.8; 45.9 | 21.8; 46.1 | 21.9; 46.1 | 21.8; 46.1 | 21.8; 46.1 | 21.5; 46.8 | 21.6; 45.4 | 22.7; 46.1 | 22.6; 45.4 |
| 725 | 56.3; 73.9 | 67.9; 81 | 100; 100 | 18.6; 38.5 | 18.6; 38.6 | 19.1; 38.8 | 19; 38.8 | 19; 38.8 | 19.3; 38.7 | 19.3; 38.7 | 18.5; 41.2 | 18.3; 40.1 |
| 726 | 24.1; 48.2 | 21.8; 45.2 | 18.6; 38.5 | 100; 100 | 98.6; 98.6 | 96.6; 99.3 | 95.5; 98.7 | 94.4; 98.6 | 93.7; 98.9 | 92.8; 98.4 | 90.3; 96.8 | 88.1; 94.6 |
| 727 | 24.1; 47.5 | 21.9; 45.4 | 18.6; 38.6 | 98.6; 98.6 | 100; 100 | 95.7; 98.2 | 94.6; 97.6 | 93.5; 97.5 | 92.8; 97.8 | 91.9; 97.3 | 89.4; 95.7 | 87.2; 93.5 |
| 728 | 24.4; 47.9 | 21.9; 46.1 | 19.1; 38.8 | 96.6; 99.3 | 95.7; 98.2 | 100; 100 | 98.7; 99.5 | 96.9; 99.3 | 96.9; 99.6 | 95.5; 98.7 | 91.9; 97.7 | 88.7; 95.3 |
| 729 | 26; 50.2 | 21.8; 46.1 | 19.1; 38.8 | 95.5; 98.7 | 94.6; 97.6 | 98.7; 99.5 | 100; 100 | 98.2; 99.8 | 95.8; 99.1 | 96.6; 99.1 | 92.8; 97.8 | 89.7; 95.9 |
| 730 | 25.7; 47.8 | 21.8; 46.1 | 19; 38.4 | 94.4; 98.6 | 93.5; 97.5 | 96.9; 99.3 | 98.2; 99.8 | 100; 100 | 94.6; 98.9 | 97.5; 99.5 | 92.1; 97 | 89.2; 96.4 |
| 731 | 24.5; 47.8 | 21.5; 46.8 | 19; 39.8 | 93.7; 98.9 | 92.8; 97.8 | 96.9; 99.6 | 95.8; 99.1 | 94.6; 98.9 | 100; 100 | 93.1; 98.7 | 90.6; 97.7 | 86.9; 95.3 |
| 732 | 26; 50.7 | 21.6; 45.4 | 19.3; 38.7 | 92.8; 98.4 | 91.9; 97.3 | 95.5; 98.7 | 96.6; 99.1 | 97.5; 99.5 | 93.1; 98.7 | 100; 100 | 90.6; 97.3 | 88.1; 95.9 |
| 733 | 25.7; 50.1 | 22.5; 45.2 | 18.5; 41.2 | 90.3; 96.8 | 89.4; 95.7 | 91.9; 97.7 | 92.8; 97.8 | 92.1; 97 | 90.6; 97.7 | 90.6; 97.3 | 100; 100 | 93.9; 97.1 |
| 734 | 25.5; 47.3 | 22.4; 44.6 | 18.3; 40.1 | 88.1; 94.6 | 87.2; 93.5 | 88.7; 95.3 | 89.7; 95.9 | 89.2; 96.4 | 86.9; 95.3 | 88.1; 95.9 | 93.9; 97.1 | 100; 100 |
| 735 | 25; 49.6 | 22.7; 46 | 18.8; 40.4 | 85.4; 95.7 | 84.7; 94.6 | 86.3; 96 | 87.2; 96.2 | 86.8; 96 | 85.9; 96.4 | 85.7; 95.9 | 92.6; 97.5 | 89.5; 95.9 |
| 736 | 25.4; 47.6 | 23.1; 45.2 | 17.8; 37.8 | 84.4; 94.4 | 83.5; 93.3 | 84.4; 94.8 | 85.1; 95.1 | 84.6; 94.9 | 83.7; 94.9 | 83.9; 94.9 | 88.8; 96 | 92.2; 98 |
| 737 | 25.3; 50.5 | 22.6; 46.6 | 18.6; 39.4 | 81.9; 93.3 | 81.2; 92.2 | 82.4; 93.7 | 82.8; 94 | 81.9; 94 | 82.1; 93.8 | 81.3; 94.4 | 84.7; 94.8 | 86.6; 95.5 |
| 738 | 25; 49 | 22.7; 45.8 | 18.4; 39.2 | 81.3; 92.1 | 80.5; 91 | 81.8; 92.4 | 82.2; 92.8 | 81.6; 92.3 | 81.3; 93 | 81.1; 92.8 | 83.9; 93.6 | 85.7; 94.1 |

TABLE 15-continued

Monophyletic group I: ICM147 Family (Global Identity; Global Similarity) of SEQ ID Nos 553-554, 725-734

| SEQ ID NO | 553 | 554 | 725 | 726 | 727 | 728 | 729 | 730 | 731 | 732 | 733 | 734 |
|---|---|---|---|---|---|---|---|---|---|---|---|---|
| 739 | 24.8; 49.4 | 22.8; 45.5 | 18.6; 39.8 | 80.2; 92.5 | 79.3; 91.4 | 80.3; 92.6 | 80.6; 92.8 | 79.7; 92.8 | 79.4; 93 | 79.5; 93.2 | 84.3; 94.8 | 89.3; 96.4 |
| 740 | 25; 51.5 | 22.2; 45.5 | 18.7; 39.9 | 79.4; 94 | 78.3; 92.9 | 79.7; 94.4 | 79.7; 94.4 | 80.1; 94.4 | 78.4; 94.4 | 79.9; 94.4 | 82.1; 95.3 | 84.2; 95.5 |
| 741 | 23.8; 45.5 | 20.7; 46.8 | 18.6; 37.8 | 77.4; 80.2 | 76.7; 79.3 | 80.2; 80.8 | 79.2; 80.4 | 77.9; 80.2 | 78.3; 80.7 | 77; 79.9 | 74.5; 79.5 | 71.6; 77.9 |
| 742 | 24.5; 48.6 | 22.1; 45.5 | 18.7; 40.5 | 76.7; 89.1 | 76; 88 | 76.9; 89.3 | 77.3; 89.8 | 77.1; 89.8 | 77.7; 90.1 | 76.3; 90.4 | 79.8; 90.9 | 80.7; 93 |
| 743 | 24.9; 49.5 | 23.2; 45.3 | 19; 41.7 | 76.2; 89.4 | 75.2; 88.4 | 76.4; 89.8 | 76.4; 89.8 | 76.7; 90.1 | 76.4; 89.8 | 75.5; 89.8 | 78.9; 91 | 80; 91.7 |
| 744 | 26.1; 51.3 | 24.5; 46.5 | 20.4; 40.9 | 74.8; 89.8 | 74.1; 88.7 | 75.7; 90.3 | 76.2; 90.7 | 75.5; 90.5 | 75; 90.5 | 74.6; 90.5 | 79.3; 91.8 | 80.7; 92.3 |
| 745 | 28.6; 55.6 | 26.8; 55.4 | 21.8; 45.4 | 70.3; 72.3 | 71; 73 | 72.8; 73 | 72.1; 72.6 | 71; 72.5 | 71.2; 73 | 70.2; 72.3 | 68.4; 72 | 66.1; 70.7 |
| 746 | 24.8; 49.4 | 22.8; 45.5 | 18.5; 39.4 | 79.7; 92.5 | 78.8; 91.4 | 79.7; 92.6 | 80.1; 92.8 | 79.2; 92.8 | 79; 93 | 79; 93 | 84.1; 94.6 | 88.8; 96.2 |
| 747 | 25.3; 46.6 | 22.2; 44.5 | 18; 40 | 88.4; 96.2 | 87.5; 95.1 | 89; 96.7 | 90; 97.3 | 89.1; 97.1 | 87; 96.7 | 88.2; 96.9 | 95.1; 98.4 | 96.6; 98.6 |
| 748 | 25.6; 47.2 | 22.7; 45.1 | 17.8; 38.2 | 85.3; 95.7 | 84.4; 94.6 | 85.7; 96 | 86.6; 96.6 | 85.7; 96.4 | 84.6; 96 | 84.6; 96.2 | 90.6; 97.5 | 92.6; 98 |
| 749 | 24.9; 47.8 | 22.9; 45 | 17.5; 39.7 | 84.8; 94.8 | 83.9; 93.7 | 84.8; 95.3 | 85.3; 95.3 | 84.4; 95.1 | 84.2; 95.5 | 84.1; 95.7 | 88.6; 96 | 90.2; 96.9 |
| 750 | 25.2; 50.8 | 22.9; 45.2 | 18.8; 41 | 79; 93.1 | 77.9; 92 | 79.2; 93.5 | 79.2; 93.5 | 79.4; 93.1 | 78.6; 93.5 | 78.1; 93.3 | 82.1; 94.6 | 83.7; 95.3 |
| 751 | 24.5; 48.2 | 21.7; 46.1 | 19; 39.9 | 92; 98.4 | 91.1; 97.3 | 94.6; 99.1 | 93.5; 98.4 | 92.6; 98.2 | 96; 99.1 | 91.3; 98 | 88.5; 96.4 | 86.1; 94.8 |
| 752 | 26.5; 50.5 | 22.4; 46.2 | 18.6; 37.2 | 85.4; 88.2 | 84.6; 87.2 | 88.5; 88.8 | 87.4; 88.4 | 85.9; 88.2 | 86.6; 88.7 | 85; 87.9 | 82.2; 87.4 | 79; 85.8 |
| 753 | 25.4; 50.9 | 21.6; 46.1 | 19.3; 38.7 | 93.5; 98.7 | 92.6; 97.6 | 96; 99.3 | 97.1; 99.6 | 98.4; 99.8 | 93.7; 98.9 | 98.6; 99.5 | 91.7; 97.8 | 88.6; 95.9 |
| 754 | 25.2; 50.5 | 21.6; 46.1 | 18.8; 38.4 | 94.2; 98.2 | 93.3; 97.1 | 96; 98.6 | 97.3; 99.1 | 98.2; 99.5 | 93.8; 98.4 | 96; 98.9 | 91.2; 97.3 | 88.1; 95.3 |
| 755 | 25.2; 50.6 | 23.4; 46 | 18; 40.6 | 69.2; 89.9 | 68.5; 88.8 | 69.6; 90.4 | 70.1; 90.8 | 70.1; 90.6 | 69.2; 90 | 69.2; 90.4 | 72.7; 91.5 | 73.9; 92.8 |
| 756 | 24.7; 47.3 | 21.9; 46.1 | 19.1; 38.8 | 96.2; 98.9 | 95.3; 97.8 | 99.5; 99.8 | 98.2; 99.3 | 97.1; 99.1 | 97.1; 99.8 | 95.3; 98.9 | 92.1; 97.5 | 88.5; 95.1 |
| 757 | 25; 47.9 | 22.3; 44.5 | 19.1; 39.5 | 96; 99.5 | 95.1; 98.4 | 95.8; 99.3 | 94.9; 98.7 | 93.7; 98.7 | 93.3; 99.3 | 92.2; 98.6 | 89.9; 96.9 | 87; 95 |
| 758 | 24.6; 49.8 | 22.4; 45.7 | 17.6; 40.4 | 80.3; 92.8 | 79.4; 91.7 | 80.8; 93.5 | 81.3; 93.7 | 80.8; 93.1 | 80.3; 94 | 80.1; 93.5 | 83; 93.7 | 84.4; 94 |
| 759 | 24.3; 46.7 | 20.9; 47.5 | 19; 39.8 | 75.7; 78.5 | 75; 77.6 | 78.5; 79 | 77.4; 78.6 | 76.2; 78.5 | 76.6; 78.9 | 75.3; 78.2 | 72.8; 77.7 | 70; 76.2 |

TABLE 16

Monophyletic group I: ICM147 Family (Global Identity; Global Similarity) of SEQ ID Nos 735-746

| SEQ ID NO | 735 | 736 | 737 | 738 | 739 | 740 | 741 | 742 | 743 | 744 | 745 | 746 |
|---|---|---|---|---|---|---|---|---|---|---|---|---|
| 432 | 23.1; 46.6 | 22.5; 47.3 | 23.6; 49.8 | 23.3; 48.6 | 23.2; 47.7 | 25.3; 47.7 | 23.1; 46.5 | 22.7; 47.1 | 24; 48.7 | 24; 48.4 | 27.3; 54.5 | 23.7; 47.7 |
| 482 | 22; 45.8 | 22.2; 45.6 | 21.5; 45.9 | 21.6; 45.7 | 23; 47.5 | 23.6; 46.9 | 22.6; 45.4 | 22.7; 45.9 | 24.1; 48.2 | 23.4; 48.3 | 26; 59.9 | 23.4; 48 |
| 483 | 85.6; 95.9 | 84.6; 94.6 | 82.1; 95.8 | 81.4; 92.3 | 80.4; 92.6 | 79.5; 94.2 | 77.6; 80.4 | 76.9; 89.3 | 76.4; 89.6 | 75; 90 | 70.5; 72.5 | 79.9; 92.6 |
| 484 | 80.4; 92.5 | 83.3; 94.9 | 79.5; 93.7 | 79.5; 93.2 | 99.3; 100 | 79; 93.5 | 64.8; 76.3 | 77.3; 91.5 | 76.4; 89.6 | 74.5; 89.6 | 60.7; 68.7 | 99.5; 99.8 |
| 485 | 86.5; 96 | 84.1; 94.4 | 81.5; 93.8 | 80.8; 91.6 | 80.3; 92.6 | 79.7; 93.8 | 76.7; 79.6 | 76.6; 90 | 76.4; 89.8 | 75.1; 90 | 70.1; 72.4 | 79.7; 92.5 |
| 486 | 84.5; 95.3 | 82.8; 94 | 81.2; 93.5 | 80.4; 92.1 | 78.8; 92.1 | 78.1; 93.8 | 78; 80.5 | 76.2; 89.1 | 75.9; 89.6 | 74.4; 89.6 | 70.7; 72.6 | 78.3; 92.1 |
| 547 | 23; 46.6 | 22.5; 47.3 | 23.5; 49.8 | 23.2; 48.6 | 23.1; 47.7 | 23.2; 47.7 | 23; 46.5 | 22.6; 47.1 | 23.9; 48.7 | 23.9; 48.6 | 27.5; 54.5 | 23.6; 47.7 |
| 548 | 24.2; 47.4 | 23.7; 48.1 | 24.7; 50.6 | 24.4; 49.4 | 24.3; 48.3 | 25.9; 48.2 | 24; 47.8 | 23.9; 48.4 | 25.1; 49.5 | 24.9; 49.2 | 28.4; 55.4 | 24.8; 48.3 |
| 549 | 24.7; 48 | 24.2; 48.7 | 25.3; 51.2 | 25; 50 | 24.9; 49 | 26.5; 48.8 | 24.5; 48.4 | 24.4; 49 | 25.6; 50.2 | 25.3; 49.8 | 29.1; 55.8 | 25.4; 49 |
| 550 | 22.7; 47.9 | 23.7; 46.8 | 24.5; 48 | 24; 46.9 | 22.6; 48.5 | 24.6; 47.6 | 24.4; 46.4 | 22.6; 45.7 | 24.9; 48.9 | 24.8; 49.1 | 28.4; 56.3 | 23.3; 48.3 |
| 551 | 23.6; 47 | 23.1; 48.2 | 23.5; 48.7 | 23.2; 47 | 23.1; 47.7 | 24; 47.2 | 22.1; 42.6 | 23.1; 46.7 | 23.5; 47.2 | 24.2; 48.6 | 28.3; 57.5 | 23.1; 47.7 |
| 552 | 21.5; 49.1 | 22.1; 45.7 | 23.1; 48.3 | 21.7; 45.4 | 22.9; 45.9 | 22.4; 47.7 | 21.2; 48.1 | 22.3; 47.1 | 23.6; 47.8 | 23; 46.1 | 26.4; 58.3 | 22.5; 46.2 |
| 553 | 25; 49.6 | 25.4; 47.6 | 25.3; 50.5 | 25; 49 | 24.8; 49.4 | 25; 51.5 | 23.8; 45.5 | 24.5; 48.6 | 24.9; 49.5 | 26.1; 51.3 | 28.6; 55.6 | 24.8; 49.4 |
| 554 | 22.7; 46 | 23.4; 46.1 | 22.6; 46.6 | 22.7; 45.8 | 23; 46.4 | 22.2; 45.5 | 20.7; 46.8 | 22.1; 45.5 | 23.2; 45.3 | 24.5; 46.5 | 26.8; 55.4 | 23; 46.4 |
| 725 | 18.8; 40.4 | 17.8; 37.8 | 18.6; 39.4 | 18.4; 39.2 | 18.6; 39.8 | 18.7; 39.9 | 18.6; 37.8 | 18.7; 40.5 | 19; 41.7 | 20.4; 40.9 | 21.8; 45.4 | 18.5; 39.4 |
| 726 | 85.4; 95.7 | 84.4; 94.4 | 81.9; 93.3 | 81.3; 92.1 | 80.2; 92.5 | 79.4; 94 | 77.4; 80.2 | 76.7; 89.1 | 76.2; 89.4 | 74.8; 89.8 | 70.3; 72.3 | 79.7; 92.5 |
| 727 | 84.7; 94.6 | 83.5; 93.3 | 81.2; 92.2 | 80.5; 91 | 79.3; 91.4 | 78.3; 92.9 | 76.7; 79.3 | 76; 88 | 75.2; 88.4 | 74.1; 88.7 | 71; 73 | 78.8; 91.4 |
| 728 | 86.3; 96 | 84.4; 94.8 | 82.4; 93.7 | 81.8; 92.4 | 80.3; 92.6 | 79.7; 94.4 | 80.2; 80.8 | 76.9; 89.3 | 76.4; 89.8 | 75.7; 90.3 | 72.8; 73 | 79.7; 92.6 |
| 729 | 87.2; 96.2 | 85.1; 95.1 | 82.8; 94 | 82.2; 92.8 | 80.6; 92.8 | 79.7; 94.4 | 79.2; 80.4 | 77.3; 89.8 | 76.4; 89.8 | 76.2; 90.7 | 72.1; 72.6 | 80.1; 92.8 |
| 730 | 86.8; 96 | 84.6; 94.9 | 81.9; 94 | 81.6; 92.3 | 79.7; 92.8 | 80.1; 94.4 | 77.9; 80.2 | 77.1; 89.8 | 76.7; 90.1 | 75.5; 90.5 | 71; 72.5 | 79.2; 92.8 |
| 731 | 85.9; 96.4 | 83.7; 94.9 | 82.1; 93.8 | 81.3; 93 | 79.4; 93 | 78.4; 94.4 | 78.3; 80.7 | 77.5; 90.1 | 76.4; 89.8 | 75; 90.5 | 71.2; 73 | 79; 93 |
| 732 | 85.7; 95.9 | 83.9; 94.9 | 81.3; 94.4 | 81.1; 92.8 | 79.5; 93.2 | 79.9; 94.4 | 77; 79.9 | 76.3; 90.4 | 75.5; 89.8 | 74.6; 90.5 | 70.2; 72.3 | 79; 93 |
| 733 | 92.6; 97.5 | 88.8; 96 | 84.7; 94.8 | 83.9; 93.6 | 84.3; 94.8 | 82.1; 95.3 | 74.5; 79.5 | 79.8; 90.9 | 78.9; 91 | 79.3; 91.8 | 68.4; 72 | 84.1; 94.6 |
| 734 | 89.5; 95.9 | 92.2; 98 | 86.6; 95.5 | 85.7; 94.1 | 89.3; 96.4 | 84.2; 95.5 | 71.6; 77.9 | 80.7; 93 | 80; 91.7 | 80.7; 92.3 | 66.1; 70.7 | 88.8; 96.2 |
| 735 | 100; 100 | 84.5; 95 | 81.4; 93.1 | 80.6; 92.3 | 80.1; 92.5 | 78.3; 93.5 | 70.2; 78.6 | 77.2; 90.5 | 75.1; 89.5 | 76.1; 91.1 | 65.7; 71.5 | 80.1; 92.5 |
| 736 | 84.5; 95 | 100; 100 | 89.9; 96.2 | 91.3; 95.9 | 83.3; 94.9 | 86.2; 96.4 | 68.2; 77.3 | 83.8; 93.5 | 81.4; 92.4 | 86.8; 94.1 | 63.4; 69.7 | 83.3; 94.9 |
| 737 | 81.4; 93.1 | 89.9; 96.2 | 100; 100 | 95.9; 98.4 | 79.5; 93.5 | 80.1; 94.4 | 67; 76.1 | 87.6; 95.5 | 76.9; 90.5 | 81.1; 92.3 | 61.8; 69 | 79.2; 93.5 |
| 738 | 80.6; 92.3 | 91.3; 95.9 | 95.9; 98.4 | 100; 100 | 79.5; 93 | 80.4; 93.5 | 67.4; 75.8 | 89.4; 96.4 | 76.3; 89.5 | 81.3; 91.8 | 61.5; 68.4 | 79.3; 93.3 |
| 739 | 80.1; 92.5 | 83.3; 94.9 | 79.5; 93.5 | 79.5; 93 | 100; 100 | 79.2; 93.5 | 64.8; 76.1 | 77.3; 91.4 | 76.4; 89.6 | 74.3; 89.6 | 60.8; 68.5 | 99.1; 99.8 |
| 740 | 78.3; 93.5 | 86.2; 96.4 | 80.1; 94.4 | 80.4; 93.5 | 79.2; 93.5 | 100; 100 | 64.4; 76.1 | 77.1; 91.9 | 87.5; 93.9 | 76.2; 92.1 | 59; 69 | 79; 93.3 |
| 741 | 70.2; 78.6 | 68.2; 77.3 | 67; 76.1 | 67.4; 75.8 | 64.8; 76.1 | 64.4; 76.1 | 100; 100 | 63; 74 | 63.2; 74.5 | 62.3; 74.2 | 74.2; 74.2 | 64.4; 76.1 |
| 742 | 77.2; 90.5 | 83.8; 93.5 | 87.6; 95.5 | 89.4; 96.4 | 77.3; 91.4 | 77.1; 91.9 | 63; 74 | 100; 100 | 73.4; 87.2 | 74.5; 90 | 58.6; 66.4 | 77.3; 91.5 |
| 743 | 75.1; 89.5 | 81.4; 92.4 | 76.9; 90.5 | 76.3; 89.5 | 76.4; 89.6 | 87.5; 93.9 | 63.2; 74.5 | 73.4; 87.2 | 100; 100 | 72.7; 87.8 | 56.8; 65.9 | 76.4; 89.4 |
| 744 | 76.1; 91.1 | 86.8; 94.1 | 81.1; 92.3 | 81.3; 91.8 | 74.3; 89.6 | 76.2; 92.1 | 62.3; 74.2 | 74.5; 90 | 72.7; 87.8 | 100; 100 | 57.3; 67.1 | 74.3; 89.8 |
| 745 | 65.7; 71.5 | 63.4; 69.7 | 61.8; 69 | 61.5; 68.4 | 60.8; 68.5 | 59; 69 | 74.2; 74.2 | 58.6; 66.4 | 56.8; 65.9 | 57.3; 67.1 | 100; 100 | 60.3; 68.5 |
| 746 | 80.1; 92.5 | 83.3; 94.9 | 79.2; 93.5 | 79.3; 93.3 | 99.1; 99.8 | 79; 93.3 | 64.4; 76.1 | 77.3; 91.5 | 76.4; 89.4 | 74.3; 89.8 | 60.3; 68.5 | 100; 100 |
| 747 | 89.5; 96.6 | 91.7; 97.6 | 88; 96.6 | 86.3; 94.8 | 87.5; 95.7 | 84.6; 96 | 71; 78.6 | 81.8; 93.3 | 80.6; 92 | 80.7; 92.8 | 65.9; 71 | 87; 95.5 |
| 748 | 85.7; 96 | 94; 98.2 | 91.9; 97.3 | 89; 95.7 | 83.7; 94.9 | 85.2; 96.2 | 68.9; 77.9 | 83.2; 93.3 | 81.8; 92.2 | 83.2; 93.9 | 63.9; 70.5 | 83.7; 94.8 |
| 749 | 83.4; 94.8 | 92.4; 97.6 | 89.7; 97.1 | 89.4; 96.9 | 82.4; 95.5 | 83.5; 95.6 | 68.6; 77.3 | 82.9; 93.5 | 79.7; 91.1 | 81.2; 92.5 | 63.3; 69.8 | 82.4; 95.5 |
| 750 | 78.2; 93.3 | 85.1; 95.8 | 79.6; 93.3 | 79.1; 92.6 | 79.7; 92.6 | 91.1; 98.2 | 64.1; 75.4 | 75.9; 90.5 | 92.9; 94.6 | 76.2; 91.2 | 59.2; 68.7 | 79.9; 92.4 |
| 751 | 84.3; 95.3 | 83; 93.5 | 80.6; 93.1 | 80; 92.1 | 78.3; 91.9 | 77.5; 93.3 | 76.4; 80.2 | 76; 88.9 | 75; 88.9 | 73.9; 89.8 | 69.2; 72.3 | 77.9; 91.9 |

TABLE 16-continued

Monophyletic group I: ICM147 Family (Global Identity; Global Similarity) of SEQ ID Nos 735-746

| SEQ ID NO | 735 | 736 | 737 | 738 | 739 | 740 | 741 | 742 | 743 | 744 | 745 | 746 |
|---|---|---|---|---|---|---|---|---|---|---|---|---|
| 752 | 77.8; 85.9 | 75.7; 84.8 | 74.1; 83.8 | 74.1; 83.3 | 71.7; 83.7 | 70.5; 83.8 | 90.3; 90.3 | 69.9; 80.9 | 68.7; 80.2 | 68.8; 81.7 | 82.1; 82.1 | 71.2; 83.7 |
| 753 | 86.6; 96.2 | 84.4; 94.9 | 81.5; 94.2 | 80.9; 92.4 | 79.8; 93.9 | 80.4; 94.4 | 77.1; 80.2 | 76.6; 90 | 76.6; 89.9 | 75.1; 90.5 | 70; 72.5 | 79.2; 93.7 |
| 754 | 85.9; 96 | 84.1; 94.9 | 81.3; 93.8 | 80.9; 92.8 | 79.1; 93.3 | 79.5; 94.6 | 77.1; 79.8 | 76.6; 89.8 | 76.6; 89.9 | 75; 90.7 | 70.2; 72 | 78.9; 93.5 |
| 755 | 70.4; 90.8 | 77.9; 93.3 | 75.7; 92 | 74.6; 91.2 | 68.9; 89.1 | 70.3; 92 | 57.2; 73.6 | 71.5; 89.7 | 67.4; 87.9 | 82.5; 94.5 | 53.8; 66.4 | 68.8; 89.1 |
| 756 | 86.5; 95.9 | 84.2; 94.6 | 82.6; 93.8 | 82; 92.6 | 80.3; 92.8 | 79.4; 94 | 80.1; 80.8 | 77.5; 89.5 | 76.6; 89.6 | 75.5; 90.2 | 72.6; 73 | 79.7; 92.8 |
| 757 | 85.4; 95.7 | 83.5; 94.4 | 81.9; 93.7 | 81.1; 92.4 | 80; 93 | 78.1; 94 | 77.1; 80.4 | 76.4; 89.5 | 75.7; 89.6 | 75; 90 | 70; 72.5 | 79.5; 93 |
| 758 | 79.4; 92.5 | 86.2; 94.9 | 83.7; 94.6 | 84.3; 94.4 | 78; 93.1 | 78.2; 92 | 65.4; 75.8 | 77.9; 91.7 | 74.1; 89 | 76; 90.3 | 61.2; 68.5 | 78.2; 93.1 |
| 759 | 68.7; 76.9 | 66.7; 75.6 | 65.5; 74.4 | 65.9; 74.2 | 63.4; 74.4 | 62.9; 74.4 | 97.8; 97.8 | 61.9; 72.5 | 61.9; 72.9 | 60.9; 72.6 | 72.6; 72.6 | 62.9; 74.4 |

TABLE 17

Monophyletic group I: ICM147 Family (Global Identity; Global Similarity) of SEQ ID Nos 747-759

| SEQ ID NO | 747 | 748 | 749 | 750 | 751 | 752 | 753 |
|---|---|---|---|---|---|---|---|
| 432 | 24.1; 47.8 | 23.6; 47.1 | 23.3; 47.3 | 24; 48.7 | 22.6; 45.4 | 23.9; 46.4 | 22.4; 44.8 |
| 482 | 22.5; 47.3 | 21.6; 45.1 | 22; 47.1 | 22.5; 46.6 | 22.2; 45.6 | 23.1; 50.2 | 22.6; 46.9 |
| 483 | 88.6; 96.4 | 85.5; 95.8 | 85; 94.9 | 79.2; 93.3 | 92.2; 98.6 | 85.6; 88.4 | 93.7; 98.9 |
| 484 | 87.5; 95.7 | 83.7; 94.9 | 82.4; 95.5 | 79.9; 92.6 | 78.3; 92.1 | 71.7; 83.8 | 79.8; 93.9 |
| 485 | 89; 96.7 | 85.3; 96 | 83.9; 94.6 | 78.8; 93.1 | 90.9; 97.6 | 84.6; 87.5 | 97.8; 99.6 |
| 486 | 86.6; 96 | 83.7; 95.3 | 83.5; 94.9 | 77.9; 92.9 | 95.5; 99.3 | 86.3; 88.5 | 93.7; 98.6 |
| 547 | 24; 47.8 | 23.6; 47.1 | 23.2; 47.3 | 23.9; 48.7 | 22.5; 45.4 | 23.8; 46.4 | 22.3; 44.7 |
| 548 | 25.2; 48.6 | 24.7; 47.9 | 24.4; 48 | 25.1; 49.5 | 23.6; 46.2 | 24.9; 47.8 | 23.4; 46.2 |
| 549 | 25.8; 49.2 | 25.3; 48.5 | 25; 48.7 | 25.7; 50.2 | 24.2; 46.8 | 25.4; 48.4 | 23.9; 46.8 |
| 550 | 24.5; 48.2 | 25.2; 49.3 | 23.1; 47.5 | 24.6; 47.6 | 24.1; 46.2 | 24.6; 47.8 | 23.9; 45.4 |
| 551 | 23.5; 44.9 | 23.3; 48.2 | 23.7; 46.1 | 23.6; 48.4 | 22.8; 45.7 | 24.5; 48.2 | 23.1; 47.7 |
| 552 | 22.7; 47.5 | 22.8; 47.7 | 22.5; 47.9 | 22.9; 48.1 | 21.8; 45.6 | 23; 48.9 | 22.1; 47.2 |
| 553 | 25.3; 46.6 | 25.6; 47.2 | 24.9; 47.8 | 25.2; 50.8 | 24.5; 48.2 | 26.5; 50.5 | 25.4; 50.9 |
| 554 | 22.5; 45.4 | 22.9; 46 | 23.1; 45.9 | 22.9; 45.2 | 21.7; 46.1 | 22.4; 46.5 | 21.6; 46.1 |
| 725 | 18; 40 | 17.8; 38.2 | 17.5; 39.7 | 18.8; 41 | 19; 39.9 | 18.6; 37.2 | 19.3; 38.7 |
| 726 | 88.4; 96.2 | 85.3; 95.7 | 84.8; 94.8 | 79; 93.1 | 92; 98.4 | 85.4; 88.2 | 93.5; 98.7 |
| 727 | 87.5; 95.1 | 84.4; 94.6 | 83.9; 93.7 | 77.9; 92 | 91.1; 97.3 | 84.6; 87.2 | 92.6; 97.6 |
| 728 | 89; 96.7 | 85.7; 96 | 84.8; 95.3 | 79.2; 93.5 | 94.6; 99.1 | 88.5; 88.8 | 96; 99.3 |
| 729 | 90; 97.3 | 86.6; 96.6 | 85.3; 95.3 | 79.2; 93.5 | 93.5; 98.4 | 87.4; 88.4 | 97.1; 99.6 |
| 730 | 89.1; 97.1 | 85.7; 96.4 | 84.4; 95.1 | 79.4; 93.1 | 92.6; 98.2 | 85.9; 88.2 | 98.4; 99.8 |
| 731 | 87; 96.7 | 84.6; 96 | 84.2; 95.5 | 78.6; 93.5 | 96; 99.1 | 86.6; 88.7 | 93.7; 98.9 |
| 732 | 88.2; 96.9 | 84.6; 96.2 | 84.1; 95.7 | 78.1; 93.3 | 91.3; 98 | 85; 87.9 | 98.6; 99.5 |
| 733 | 95.1; 98.4 | 90.6; 97.5 | 88.6; 96 | 82.1; 94.6 | 88.5; 96.4 | 82.2; 87.4 | 91.7; 97.8 |
| 734 | 96.6; 98.6 | 92.6; 98 | 90.2; 96.9 | 83.7; 95.3 | 86.1; 94.8 | 79; 85.8 | 88.6; 95.9 |
| 735 | 89.5; 96.6 | 85.7; 96 | 83.4; 94.8 | 78.2; 93.3 | 84.3; 95.3 | 77.8; 85.9 | 86.6; 96.2 |
| 736 | 91.7; 97.6 | 94; 98.2 | 92.4; 97.6 | 85.1; 95.8 | 83; 93.5 | 75.7; 84.8 | 84.4; 94.9 |
| 737 | 88; 96.6 | 91.9; 97.3 | 89.7; 97.1 | 79.6; 93.3 | 80.6; 93.1 | 74.1; 83.8 | 81.5; 94.2 |
| 738 | 86.3; 94.8 | 89; 95.7 | 89.4; 96.9 | 79.1; 92.6 | 80; 92.1 | 74.1; 83.3 | 80.9; 92.4 |
| 739 | 87.5; 95.7 | 83.7; 94.9 | 82.4; 95.5 | 79.7; 92.6 | 78.3; 91.9 | 71.7; 83.7 | 79.8; 93.9 |
| 740 | 84.6; 96 | 85.2; 96.2 | 83.5; 95.6 | 91.1; 98.2 | 77.5; 93.3 | 70.5; 83.8 | 80.4; 94.4 |
| 741 | 71.6; 78.6 | 68.9; 77.9 | 68.6; 77.3 | 64.1; 75.4 | 76.4; 80.2 | 90.3; 90.3 | 77.1; 80.2 |
| 742 | 81.8; 93.3 | 83.2; 93.3 | 82.9; 93.5 | 75.9; 90.5 | 76; 88.9 | 69.9; 80.9 | 76.6; 90 |
| 743 | 80.6; 92 | 81.8; 92.2 | 79.7; 91.1 | 92.9; 94.6 | 75; 88.9 | 68.7; 80.2 | 76.6; 89.9 |
| 744 | 80.7; 92.8 | 83.2; 93.9 | 81.2; 92.5 | 76.2; 91.2 | 73.9; 89.8 | 68.8; 81.7 | 75.1; 90.5 |
| 745 | 65.9; 71 | 63.9; 70.5 | 63.3; 69.8 | 59.2; 68.7 | 69.2; 72.3 | 82.1; 82.1 | 70; 72.5 |
| 746 | 87; 95.5 | 83.7; 94.8 | 82.4; 95.5 | 79.9; 92.4 | 77.9; 91.9 | 71.2; 83.7 | 79.2; 93.7 |
| 747 | 100; 100 | 95.3; 99.1 | 91.7; 97.5 | 84.1; 95.5 | 85.3; 95.7 | 79; 86.4 | 89; 97.1 |
| 748 | 95.3; 99.1 | 100; 100 | 93.7; 97.3 | 85.4; 95.7 | 83; 94.9 | 76.4; 85.8 | 85.3; 96.4 |
| 749 | 91.7; 97.5 | 93.7; 97.3 | 100; 100 | 83.7; 94.4 | 82.8; 94.4 | 76.2; 84.8 | 84.4; 95.1 |
| 750 | 84.1; 95.5 | 85.4; 95.7 | 83.7; 94.4 | 100; 100 | 78.1; 92.6 | 71.5; 83.3 | 79.2; 93.5 |
| 751 | 85.3; 95.7 | 83; 94.9 | 82.8; 94.4 | 78.1; 92.6 | 100; 100 | 84.5; 88.2 | 91.7; 98.2 |
| 752 | 79; 86.4 | 76.4; 85.8 | 76.2; 84.8 | 71.5; 83.3 | 84.5; 88.2 | 100; 100 | 85.1; 88.2 |
| 753 | 89; 97.1 | 85.3; 96.4 | 84.4; 95.1 | 79.2; 93.5 | 91.7; 98.2 | 85.1; 88.2 | 100; 100 |
| 754 | 88.2; 96.9 | 85.1; 96.2 | 84.1; 95.1 | 79.2; 93.5 | 91.9; 98 | 85.1; 87.7 | 96.9; 99.3 |

TABLE 17-continued

Monophyletic group I: ICM147 Family (Global Identity; Global Similarity) of SEQ ID Nos 747-759

| | | | | | | | |
|---|---|---|---|---|---|---|---|
| 755 | 75.5; 92.9 | 78.6; 94 | 77; 92.8 | 69.9; 91.3 | 68.1; 90 | 62.5; 81.1 | 69.8; 90.4 |
| 756 | 88.8; 96.6 | 85.5; 95.8 | 85; 95.5 | 79.2; 93.1 | 94.8; 99.3 | 88.4; 88.8 | 95.8; 99.1 |
| 757 | 87.7; 96.4 | 84.8; 95.8 | 84.1; 95.3 | 78.3; 93.1 | 91.5; 98.7 | 85.1; 88.4 | 92.8; 98.7 |
| 758 | 84.6; 94.2 | 86.8; 94.8 | 90; 96.6 | 77.3; 92.2 | 79.4; 92.8 | 72; 83.2 | 80.4; 93.1 |
| 759 | 70; 76.9 | 67.4; 76.2 | 67.4; 75.7 | 62.6; 73.7 | 74.7; 78.5 | 88.4; 88.4 | 75.4; 78.5 |

| SEQ ID NO | 754 | 755 | 756 | 757 | 758 | 759 |
|---|---|---|---|---|---|---|
| 432 | 22.5; 43.6 | 23.1; 47.6 | 23.1; 45 | 22.8; 45.7 | 24.1; 47.5 | 23.8; 47.7 |
| 482 | 22.1; 46.4 | 20.9; 48.2 | 22.3; 45.2 | 22.2; 46.6 | 21; 47.5 | 22.6; 45.8 |
| 483 | 94.4; 98.4 | 69.4; 90 | 96.4; 99.1 | 96.2; 99.6 | 80.4; 92.9 | 75.9; 78.6 |
| 484 | 79.3; 93.5 | 68.8; 89.2 | 80.3; 93 | 80; 93.2 | 78.2; 93.1 | 63.4; 74.6 |
| 485 | 95.8; 98.9 | 70.1; 89.9 | 95.5; 98.6 | 92.8; 98.2 | 80.3; 93.1 | 75; 77.9 |
| 486 | 93.8; 98 | 68.5; 89.7 | 96.7; 99.6 | 92.8; 99.1 | 79.7; 93.5 | 76.3; 78.7 |
| 547 | 22.4; 43.6 | 23.2; 47.6 | 23; 45 | 22.7; 45.6 | 24.1; 47.5 | 23.8; 47.6 |
| 548 | 23.5; 45.1 | 23.9; 48.2 | 24.1; 46.4 | 23.9; 47.1 | 25.2; 48.3 | 24.8; 49 |
| 549 | 24.1; 45.7 | 24.3; 48.7 | 24.7; 47 | 24.4; 47.7 | 25.6; 48.9 | 25.3; 49.5 |
| 550 | 22.4; 48.7 | 23.3; 49.9 | 23.9; 45.5 | 23.3; 47.3 | 24.6; 48.4 | 26; 48 |
| 551 | 22.9; 47.3 | 23.8; 47.4 | 23; 44.1 | 23.5; 44.8 | 23.2; 47.7 | 22.8; 44.5 |
| 552 | 21.8; 45.9 | 21.2; 46.8 | 22.5; 46.6 | 22.3; 46.6 | 22.3; 47.6 | 21.6; 49.1 |
| 553 | 25.2; 50.5 | 25.2; 50.6 | 24.7; 47.3 | 25; 47.9 | 24.6; 49.8 | 24.4; 46.5 |
| 554 | 21.6; 46.1 | 23.4; 46 | 21.9; 46.1 | 22.3; 45.3 | 22.4; 45.7 | 20.9; 47.5 |
| 725 | 18.8; 38.4 | 18; 40.6 | 19.1; 38.8 | 19.1; 39.5 | 17.6; 40.4 | 19; 39.8 |
| 726 | 94.2; 98.2 | 69.2; 89.9 | 96.2; 98.9 | 96; 99.5 | 80.3; 92.8 | 75.7; 78.5 |
| 727 | 93.3; 97.1 | 68.5; 88.8 | 95.3; 97.8 | 95.1; 98.4 | 79.4; 91.7 | 75; 77.6 |
| 728 | 96; 98.6 | 69.6; 90.4 | 99.5; 99.8 | 95.8; 99.3 | 80.8; 93.5 | 78.5; 79 |
| 729 | 97.3; 99.1 | 70.1; 90.8 | 98.2; 99.3 | 94.9; 98.7 | 81.3; 93.7 | 77.4; 78.6 |
| 730 | 98.2; 99.5 | 70.1; 90.6 | 97.1; 99.1 | 93.7; 98.7 | 80.8; 93.1 | 76.2; 78.5 |
| 731 | 93.8; 98.4 | 69.2; 90 | 97.1; 99.8 | 93.3; 99.3 | 80.3; 94 | 76.6; 78.9 |
| 732 | 96; 98.9 | 69.2; 90.4 | 95.3; 98.9 | 92.2; 98.6 | 80.1; 93.5 | 75.3; 78.2 |
| 733 | 91.2; 97.3 | 72.7; 91.5 | 92.1; 97.5 | 89.9; 96.9 | 83; 93.7 | 72.8; 77.7 |
| 734 | 88.1; 95.3 | 73.9; 92.8 | 88.5; 95.1 | 87; 95 | 84.4; 94 | 70; 76.2 |
| 735 | 85.9; 96 | 70.4; 90.8 | 86.5; 95.9 | 85.4; 95.7 | 79.4; 92.5 | 68.7; 76.9 |
| 736 | 84.1; 94.9 | 77.9; 93.3 | 84.2; 94.6 | 83.5; 94.4 | 86.2; 94.9 | 66.7; 75.6 |
| 737 | 81.3; 93.8 | 75.7; 92 | 82.6; 93.8 | 81.9; 93.7 | 83.7; 94.6 | 65.5; 74.4 |
| 738 | 80.9; 92.8 | 74.6; 91.2 | 82; 92.6 | 81.1; 92.4 | 84.3; 94.4 | 65.9; 74.2 |
| 739 | 79.1; 93.3 | 68.9; 89.1 | 80.3; 92.8 | 80; 93 | 78; 93.1 | 63.4; 74.4 |
| 740 | 79.5; 94.6 | 70.3; 92 | 79.4; 94 | 78.1; 94 | 78.2; 92 | 62.9; 74.4 |
| 741 | 77.1; 79.8 | 57.2; 73.6 | 80.1; 80.8 | 77.1; 80.4 | 65.4; 75.8 | 97.8; 97.8 |
| 742 | 76.6; 89.8 | 71.5; 89.7 | 77.5; 89.5 | 76.4; 89.5 | 77.9; 91.7 | 61.9; 72.5 |
| 743 | 76.6; 89.9 | 67.4; 87.9 | 76.6; 89.6 | 75.7; 89.6 | 74.1; 89 | 61.9; 72.9 |
| 744 | 75; 90.7 | 82.5; 94.5 | 75.5; 90.2 | 75; 90 | 76; 90.3 | 60.9; 72.6 |
| 745 | 70.2; 72 | 53.8; 66.4 | 72.6; 73 | 70; 72.5 | 61.2; 68.5 | 72.6; 72.6 |
| 746 | 78.9; 93.5 | 68.8; 89.1 | 79.7; 92.8 | 79.5; 93 | 78.2; 93.1 | 62.9; 74.4 |
| 747 | 88.2; 96.9 | 75.5; 92.9 | 88.8; 96.6 | 87.7; 96.4 | 84.6; 94.2 | 70; 76.9 |
| 748 | 85.1; 96.2 | 78.6; 94 | 85.5; 95.8 | 84.8; 95.8 | 86.8; 94.8 | 67.4; 76.2 |
| 749 | 84.1; 95.1 | 77; 92.8 | 85; 95.5 | 84.1; 95.3 | 90; 96.6 | 67.4; 75.7 |
| 750 | 79.2; 93.5 | 69.9; 91.3 | 79.2; 93.1 | 78.3; 93.1 | 77.3; 92.2 | 62.6; 73.7 |
| 751 | 91.9; 98 | 68.1; 90 | 94.8; 99.3 | 91.5; 98.7 | 79.4; 92.8 | 74.7; 78.5 |
| 752 | 85.1; 87.7 | 62.5; 81.1 | 88.4; 88.8 | 85.1; 88.4 | 72; 83.2 | 88.4; 88.4 |
| 753 | 96.9; 99.3 | 69.8; 90.4 | 95.8; 99.1 | 92.8; 98.7 | 80.4; 93.1 | 75.4; 78.5 |
| 754 | 100; 100 | 69.4; 90.4 | 95.8; 98.4 | 92.9; 98.2 | 80.1; 93.1 | 75.4; 78 |
| 755 | 69.4; 90.4 | 100; 100 | 69.4; 90.2 | 69.4; 90.2 | 72; 90.1 | 56.2; 72.1 |
| 756 | 95.8; 98.4 | 69.4; 90.2 | 100; 100 | 96; 99.5 | 81; 93.7 | 78.3; 79 |
| 757 | 92.9; 98.2 | 69.4; 90.2 | 96; 99.5 | 100; 100 | 80.4; 93.3 | 75.4; 78.6 |
| 758 | 80.1; 93.1 | 72; 90.1 | 81; 93.7 | 80.4; 93.3 | 100; 100 | 64.2; 74.3 |
| 759 | 75.4; 78 | 56.2; 72.1 | 78.3; 79 | 75.4; 78.6 | 64.2; 74.3 | 100; 100 |

Tables 14-17: Pairwise global identity and similarity analyses between all members of the ICM147 family tree were calculated using EMBOSS-6.0.1 Needleman-Wunsch algorithm with all parameters carrying default values, except for two that were modified as follows: gapopen=8, gapextend=2. Global similarity calculations further utilized BLOSUM62 matrix. First value is identity; second value is similarity.

TABLE 18

Shared domains of Monophyletic group I (ICM147 family)

| Polyp. SEQ | Core Gene Name | Domain Composition of Core Gene (ID)* | start_end of the domain match (amino acid position) | E-value of the domain match | Characteristic Domains (ID)* | Homologous Polypeptides Comprising the Domains (SEQ ID NOs) | Shared Domain Description |
|---|---|---|---|---|---|---|---|
| 432 | ICM147 | 5; 5; 8; 7; 8; 8; 38 | 209_508; 227_493; 242_261; 273_484; 276_289; 444_460; 445_455 | 4.7E−38; 2.75E−37; 5.2E−10; 6.0E−13; 5.2E−10; 5.2E−10; − | 5; 7; 8; 38 in core and homologs | 547; 548; 549; 550; 551; 552; 553; 554 | Peptidase S8/S53 domain |
| 482 | ICM147_H5 | 5; 5; 8; 7; 8; 8; 38 | 208_502; 230_503; 242_261; 266_484; 276_289; 444_460; 445_455 | 3.9E−37; 4.06E−37; 1.0E−9; 7.1E−14; 1.0E−9; 1.0E−9; − | 5; 7; 8; 38 in core homologs | 552; 554; 725 | |
| 483 | ICM147_H9 | 5; 5; 7 | 150_470; 163_461; 208_438 | 1.1E−40; 1.83E−37; 8.8E−19 | 5; 7 in core and homologs | 726; 727; 728; 729; 730; 731; 732; 733; 734; 735; 736; 737; 738; 739; 740; 741; 742; 743; 744; 745 | |
| 484 | ICM147 | 5; 5; 8; 7; 8; 8; 51 | 149_470; 162_460; 176_195; 207_438; 217_230; 397_413; 481_551 | 2.0E−41; 7.33E−39; 1.7E−5; 1.7E−19; 1.7E−5; 1.7E−5; 1.5E−14 | 51; 5; 7; 8 in core and homologs | 733; 734; 735; 742; 743; 744; 746; 747; 748; 749; 750; 751; 752 | |
| 485 | ICM147_H35 | 5; 5; 7; 51 | 150_470; 163_461; 215_438; 481_550 | 1.9E−40; 8.9E−37; 8.1E−17; 3.9E−13; | 51; 5; 7 in core and homologs | 726; 729; 731; 733; 735; 737; 738; 740; 741; 742; 744; 747; 748; 749; 750; 751; 752; 753; 754; 755 | |
| 486 | ICM147_H36 | 5; 5; 8; 7; 8; 8 | 150_470; 163_461; 177_196; 215_438; 218_231; 398_414 | 7.9E−40; 2.09E−36; 4.5E−5; 5.2E−19; 4.5E−5; 4.5E−5 | 5; 7; 8 in core and homologs | 730; 731; 733; 735; 736; 737; 738; 739; 743; 744; 745; 747; 748; 750; 751; 754; 756; 757; 758; 759 | |

Table 18: *The InterPro ID (domain identifier) is depicted in Table 13 above.

**In some cases, instead of an e-value there appears "−", which indicates that domain was verified by ScanRegExp, which is able to verify PROSITE matches using corresponding statistically-significant CONFIRM patterns (P-value of $10e^{-9}$).

"Polyp." = Polypeptide.

TABLE 19

Monophyletic group II: ICM149 Family (Global Identity; Global Similarity)

| SEQ ID NO | 433 | 487 | 555 | 556 | 760 | 761 |
|---|---|---|---|---|---|---|
| 433 | 100; 100 | 65.7; 88.1 | 79.9; 95 | 79.8; 94.6 | 65.8; 88.1 | 65.8; 88.5 |
| 487 | 65.7; 88.1 | 100; 100 | 69.9; 90.8 | 68.7; 89.6 | 99.3; 99.7 | 98.8; 99.6 |
| 555 | 79.9; 95 | 69.9; 90.8 | 100; 100 | 85.3; 95.8 | 70.2; 90.8 | 70.4; 91.2 |
| 556 | 79.8; 94.6 | 68.7; 89.6 | 85.3; 95.8 | 100; 100 | 69.2; 89.6 | 69.2; 89.9 |
| 760 | 65.8; 88.1 | 99.3; 99.7 | 70.2; 90.8 | 69.2; 89.6 | 100; 100 | 98.9; 99.6 |
| 761 | 65.8; 88.5 | 98.8; 99.6 | 70.4; 91.2 | 69.2; 89.9 | 98.9; 99.6 | 100; 100 |

Table 19: Pairwise global identity and similarity analyses between all members of the ICM149 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. First value is identity; second value is similarity.

TABLE 20

| Polyp. SEQ ID NO: | Core Gene Name | Domain Composition of Core Gene (ID)* | start_end of the domain match | E-value of the domain match | Characteristic Domains (ID)* | Homologous Polypeptides Comprising the Domains (SEQ ID NOs) | Shared domain Description |
|---|---|---|---|---|---|---|---|
| 433 | ICM149 | 40; 41; 42; 42; 42; 30; 39; 39; 30 | 74_348; 110_355; 199_214; 228_247; 383_395; 463_578; 474_569; 583_680; 588_681 | 9.2E−87; 2.2E−90; 5.2E−6; 5.2E−6; 5.2E−6; 2.8E−10; 1.07E−5; 7.46E−10; 8.1E−11 | 39; 40; 30; 41; 42 in core and homologs | 555; 556 | Immunoglobulin-like fold; Invasin/intimin cell-adhesion fragments; Inverse autotransporter, beta-domain |
| 487 | ICM149_H3 | 40; 41; 42; 42; 42; 30; 39; 39; 30; 95; 95 | 78_350; 112_357; 201_216; 230_249; 298_317; 468_585; 475_572; 585_681; 591_683; 593_679; 606_668 | 7.2E−92; 2.2E−93; 1.1E−8; 1.1E−8; 1.1E−8; 1.6E−12; 4.4E−7; 1.16E−11; 8.8E−13; 0.0063; 4.9E−10 | 40; 39; 30; 41; 95; 42 in core and homologs | 760; 761 | |

Table 20: *The InterPro ID (domain identifier) is depicted in Table 13 above.
**In some cases, instead of an e-value there appears "−", which indicates that domain was verified by ScanRegExp, which is able to verify PROSITE matches using corresponding statistically-significant CONFIRM patterns (P-value of $10e^{-9}$).
"Polyp." = polypepetide.

TABLE 21

Monophyletic group III: ICM495 Family (Global Identity. Global Similarity)

| SEQ ID NO | 470 | 491 | 702 | 703 | 704 | 772 | 773 | 774 |
|---|---|---|---|---|---|---|---|---|
| 470 | 100; 100 | 23.4; 49.2 | 99.8; 99.8 | 99.6; 99.6 | 85.7; 86.9 | 23.6; 49.4 | 24.3; 49.4 | 25.7; 50.6 |
| 491 | 23.4; 49.2 | 100; 100 | 23.3; 49 | 23.2; 49.2 | 24.7; 51.4 | 99.8; 99.8 | 98.9; 99.8 | 97.5; 98.5 |
| 702 | 99.8; 99.8 | 23.3; 49 | 100; 100 | 99.4; 99.4 | 86.1; 87.1 | 23.5; 49.2 | 24.2; 49.2 | 25.6; 50.4 |
| 703 | 99.6; 99.6 | 23.2; 49.2 | 99.4; 99.4 | 100; 100 | 85.3; 86.5 | 23.4; 49.4 | 24.1; 49.4 | 25.3; 50.2 |
| 704 | 85.7; 86.9 | 24.7; 51.4 | 86.1; 87.1 | 85.3; 86.5 | 100; 100 | 24.7; 51.6 | 25.7; 51.6 | 26.9; 52.8 |
| 772 | 23.6; 49.4 | 99.8; 99.8 | 23.5; 49.2 | 23.4; 49.4 | 24.7; 51.6 | 100; 100 | 98.7; 99.6 | 97.7; 98.7 |
| 773 | 24.3; 49.4 | 98.9; 99.8 | 24.2; 49.2 | 24.1; 49.4 | 25.7; 51.6 | 98.7; 99.6 | 100; 100 | 98.5; 98.7 |
| 774 | 25.7; 50.6 | 97.5; 98.5 | 25.6; 50.4 | 25.3; 50.2 | 26.9; 52.8 | 97.7; 98.7 | 98.5; 98.7 | 100; 100 |

Table 21: Pairwise global identity and similarity analyses between all members of the ICM495 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. First value is identity; second value is similarity.

TABLE 22

Shared domains of Monophyletic group III((ICM495 Family)

| Polyp. SEQ ID NO: | Core Gene Name | Domain Composition of Core Gene (ID)* | start_end of the domain match (amino acid position) | E-value of the domain match | Characteristic Domains (ID)* | Homologous Polypeptides Comprising the Domains (SEQ ID NOs) | Shared Domain Description |
|---|---|---|---|---|---|---|---|
| 470 | ICM495 | 1; 1; 27 | 31_252; 36_248; 40_248 | 2.09E−58; 4.3E−64; 2.3E−34 | 27;1 in core and homologs | 702; 703; 704 | Pesticidal crystal protein, |

TABLE 22-continued

Shared domains of Monophyletic group III((ICM495 Family)

| Polyp. SEQ ID NO: | Core Gene Name | Domain Composition of Core Gene (ID)* | start_end of the domain match (amino acid position) | E-value of the domain match | Characteristic Domains (ID)* | Homologous Polypeptides Comprising the Domains (SEQ ID NOs) | Shared Domain Description |
|---|---|---|---|---|---|---|---|
| 491 | ICM495_H4 | 1; 1; 27 | 49_269; 63_270; 160_220 | 2.0E−31; 1.96E−27; 3.1E−7 | 27;1 in core and homologs | 772; 773; 774 | N-terminal |

Table 22: *The InterPro ID (domain identifier) is depicted in Table 13 above.
**In some cases, instead of an e-value there appears "−;", which indicates that domain was verified by ScanRegExp, which is able to verify PROSITE matches using corresponding statistically-significant CONFIRM patterns (P-value of 10$^{-e9}$).
"Polyp." = Polypeptide.

TABLE 23

Monophyletic group IV: ICM86 Family (Global Identity; Global Similarity)

| SEQ ID NO | 425 | 492 | 493 | 494 | 495 | 496 | 775 | 776 | 777 |
|---|---|---|---|---|---|---|---|---|---|
| 425 | 100; 100 | 48.1; 70.9 | 30.2; 58 | 45.6; 69.3 | 48.5; 76.1 | 53.8; 79.7 | 30.7; 58.7 | 49.1; 75.2 | 55.3; 79.8 |
| 492 | 48.1; 70.9 | 100; 100 | 28.1; 55.3 | 41.4; 66.8 | 54.7; 74.6 | 47.6; 73.1 | 27.4; 56 | 55.1; 74.2 | 49; 72.5 |
| 493 | 30.2; 58 | 28.1; 55.3 | 100; 100 | 32.4; 57.4 | 32.7; 57.4 | 27.5; 54.9 | 86.6; 96.5 | 32.5; 58.5 | 26.9; 54.5 |
| 494 | 45.6; 69.3 | 41.4; 66.8 | 32.4; 57.4 | 100; 100 | 46.7; 71 | 44.1; 69.3 | 32.5; 59 | 47.2; 71.4 | 43.3; 70.7 |
| 495 | 48.5; 76.1 | 54.7; 74.6 | 32.7; 57.4 | 46.7; 71 | 100; 100 | 44.1; 74 | 31.5; 55.2 | 94.3; 98.2 | 45; 73.7 |
| 496 | 53.8; 79.7 | 47.6; 73.1 | 27.5; 54.9 | 44.1; 69.3 | 44.1; 74 | 100; 100 | 27.2; 56.3 | 44.4; 73.5 | 87.3; 95.2 |
| 775 | 30.7; 58.7 | 27.4; 56 | 86.6; 96.5 | 32.5; 59 | 31.5; 55.2 | 27.2; 56.3 | 100; 100 | 31.7; 56.1 | 27; 53.2 |
| 776 | 49.1; 75.2 | 55.1; 74.2 | 32.5; 58.5 | 47.2; 71.4 | 94.3; 98.2 | 44.4; 73.5 | 31.7; 56.1 | 100; 100 | 45.2; 73 |
| 777 | 55.3; 79.8 | 49; 72.5 | 26.9; 54.5 | 43.3; 70.7 | 45; 73.7 | 87.3; 95.2 | 26.9; 52.7 | 45.2; 73 | 100; 100 |

Table 23: Pairwise global identity and similarity analyses between all members of the ICM86 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. First value is identity; second value is similarity.

TABLE 24

Shared domains of Monophyletic group IV (ICM86 Family)

| Polyp. SEQ ID NO: | Core Gene Name | Domain Composition of Core Gene (ID)* | Start-end of the domain match (amino acid position) | E-value of the domain match | Characteristic Domains (ID)* | Homologous Polypeptides Comprising the Domains (SEQ ID NOs) | Shared Domain Description |
|---|---|---|---|---|---|---|---|
| 425 | ICM86 | 32; 33; 30; 34; 35; 35; 35; 30; 35; 35; 35; 29; 31 | 17_206; 17_203; 212_295; 213_391; 214_285; 214_295; 216_298; 302_391; 305_391; 305_380; 307_394; 403450; 406_448 | 1.36E−44; 2.2E−36; 7.0E−18; 2.16E−22; 1.0E−7; 1.46591E−7; 13.239; 1.4E−17; 1.96454E−7; 1.6E−6; 13.823; 0.0017; 4.97E−9 | 29; 30; 31; 32; 33; 34; 35 in core | NA | Carbohydrate-binding module family 5/12; Immunoglobulin E-set; Lytic polysaccharide mono-oxygenase; Fibronectin type III |
| 492 | ICM86_H21 | 32; 33; 30; 34; 35; 35; 35; 30; 35; 35; 35; 29; 31 | 17_206; 17_203; 212_295; 213_391; 214_285; 214_295; 216_298; 302_391; 305_391; 305_380; 307_394; 403_450; 406_448 | 1.36E−44; 2.2E−36; 7.0E−18; 2.16E−22; 1.0E−7; 1.46591E−7; 13.239; 1.4E−17; 1.96454E−7; 1.6E−6; 13.823; 0.0017; 4.97E−9 | 29; 30; 31; 32; 33; 34; 35 in core | NA | |
| 493 | ICM86_H22 | 32; 33; 30; 34; 35; 35; 35; 30; 35; 35; 35; 29; 31 | 18_206; 18_204; 214_302; 216_401; 216_302; 216_292; 218_305; 309_398; 312_398; 312_388; 314_401; 406_455; 408_454 | 2.66E−43; 2.7E−31; 5.7E−14; 2.7E−20; 2.85509E−6; 0.0014; 12.174; 9.7E−15; 2.44585E−5; 0.13; 12.166; 2.0E−8; 1.83E−8 | 29; 31; 30; 32; 34; 33; 35 in core and homologs | 775 | |

TABLE 24-continued

Shared domains of Monophyletic group IV (ICM86 Family)

| Polyp. SEQ ID NO: | Core Gene Name | Domain Composition of Core Gene (ID)* | Start-end of the domain match (amino acid position) | E-value of the domain match | Characteristic Domains (ID)* | Homologous Polypeptides Comprising the Domains (SEQ ID NOs) | Shared Domain Description |
|---|---|---|---|---|---|---|---|
| 494 | ICM86_H23 | 32; 33; 30; 34; 35; 35; 35; 35; 30; 35; 35; 29; 31 | 49_201; 58_199; 216_309; 217_401; 217_313; 218_297; 218_300; 226_297; 315_400; 317_389; 319_403; 408_454; 411_452 | 1.22E−50; 7.8E−34; 5.9E−12; 4.36E−20; 14.272; 8.57321E−10; 7.4E−7; 6.7E−6; 7.2E13; 1.5E−4; 10.557; 0.0074; 1.31E−6 | 29; 31; 30; 32; 34; 33; 35 in core | NA | |
| 495 | ICM86_H24 | 32; 33; 30; 34; 35; 35; 35; 30; 35; 35; 35; 29; 31 | 10_200; 10_197; 206_297; 207_393; 208_287; 208_297; 210_300; 305_392; 307_392; 307_382; 309_395; 398_445; 406_444 | 3.5E−41; 1.7E−28; 3.6E−17; 6.32E−26; 1.3E−5; 1.60939E−10; 16.19; 7.1E−15; 4.84213E−8; 3.4E−5; 12.805; 3.2E−5; 6.93E−11 | 29; 31; 30; 32; 34; 33; 35 in core and homologs | 776 | |
| 496 | ICM86_H27 | 32; 33; 30; 34; 35; 35; 35; 30; 35; 35; 35; 35; 29; 31 | 17_206; 17_203; 214_301; 214_398; 215_301; 215_290; 217_304; 309_397; 311_397; 311_386; 313_400; 313_386; 405_452; 407_449 | 1.54E−43; 7.4E−32; 1.5E−14; 5.0E−23; 1.62389E−5; 6.3E−4; 12.671; 8.8E−19; 1.03672E−11; 7.6E−8; 16.947; 4.1E−7; 3.6E−5; 9.55E−12 | 29; 31; 30; 32; 34; 33; 35 in core and homologs | 777 | |

Table 24: *The InterPro ID (domain identifier) is depicted in Table 13 above.
**In some cases, instead of an e-value there appears "–;", which indicates that domain was verified by ScanRegExp, which is able to verify PROSITE matches using corresponding statistically-significant CONFIRM patterns (P-value of 10e$^{-9}$)
"Polyp." = polypepetide. "NA" = not applicable.

Example 5: Cloning of Bacterial Genes for Expression in E. coli

Selected genes were synthesized by Genscript for expression in E. coli. The original sequences were modified such that the codons were optimized for protein expression in E. coli (further details are available at genscript.com/tools/codon-frequency-table) and a 6 Histidine coding sequence was inserted at either the 5' or the 3' ends. In cases where the original sequences already included a native signal peptide, the native signal peptide was removed and the mature protein (i.e., the portion positioned after the cleavage site) was further modified by adding an artificial initiator Methionine immediately after the cleavage site.

All optimized genes were synthesized with 5' NcoI and 3' EcoRI restrictions sites, and in some of the genes, following insertion of the restriction site, a Glycine residue was added at the $2^{nd}$ position (after the initiator Methionine) in order to maintain the coding sequence reading frame.

Genes lacking an original (native) signal peptide were cloned into pET22bd (a modified version of pET22B+ in which the periplasmic signal peptide PelB [SEQ ID NO: was removed).

Genes having an original (native) signal peptide that was replaced with an artificial signal peptide were cloned into either the pET22bd and/or the pET22B+(purchased from Merck Millipore, merckmillipore.com/INTL/en/product/pET-22b %28%2B %29-DNA---Novagen,EMD_BIO-69744?ReferrerURL=https %3A %2F %2Fwww.google.co.il %2F&bd=1#anchor_Descrip tion) by digesting the gene and the vector with NcoI and EcoRI.

The sequence of each gene was verified by Sanger sequencing in each expression vector. All aforementioned modifications are summarized in Table 25 below.

With the optimizations and modifications described above, the synthesized sequences retain at least 80% global identity to the curated sequences from which they were obtained.

TABLE 25

Details of Synthesized Sequences for Cloning in E. coli

| Gene Name | Derived polypeptide SEQ ID NO: | Modified Polyn. SEQ ID NO: | Modified Polyp. SEQ ID NO: | Modifications |
|---|---|---|---|---|
| ICM1 | 409 | 810 | 942 | Gly & 3' His-tag added |
| ICM2 | 410 | 811 | 943 | Gly & 3' His-tag added |
| ICM11 | 411 | 812 | 944 | 3' His-tag added |
| ICM15 | 1212 | 813 | 945 | Native signal peptide removed; MetGly & 5' His-tag added |
| ICM15 | 1212 | 814 | 946 | Native signal peptide removed, replaced with pelB signal peptide in plasmid vector; MetGly & 5' His-tag added |

TABLE 25-continued

Details of Synthesized Sequences for Cloning in *E. coli*

| Gene Name | Derived polypeptide SEQ ID NO: | Modified Polyn. SEQ ID NO: | Modified Polyp. SEQ ID NO: | Modifications |
|---|---|---|---|---|
| ICM15 | 1212 | 815 | 947 | Native signal peptide removed; MetGly, 5' His-tag & 3' His-tag added |
| ICM15 | 1212 | 816 | 948 | Native signal peptide removed, replaced with pelB signal peptide in plasmid vector; MetGly, 5' His-tag & 3' His-tag added |
| ICM15 | 1212 | 817 | 949 | Native signal peptide removed; Met & 3' His-tag added |
| ICM15 | 1212 | 818 | 950 | Native signal peptide removed, replaced with pelB signal peptide in plasmid vector; Met & 3' His-tag added |
| ICM23 | 413 | 819 | 951 | Gly & 3' His-tag added |
| ICM49 | 1213 | 820 | 952 | Native signal peptide removed; Met & 3' His-tag added |
| ICM49 | 1213 | 821 | 953 | Native signal peptide removed, replaced with pelB signal peptide in plasmid vector; Met & 3' His-tag added |
| ICM57 | 415 | 822 | 954 | Gly & 3' His-tag added |
| ICM60 | 416 | 823 | 955 | Gly & 3' His-tag added |
| ICM64 | 1214 | 824 | 956 | Native signal peptide removed; MetGly & 3' His-tag added |
| ICM64 | 1214 | 825 | 957 | Native signal peptide removed, replaced with pelB signal peptide in plasmid vector; MetGly & 3' His-tag added |
| ICM73 | 418 | 826 | 958 | Gly & 3' His-tag added |
| ICM74 | 419 | 827 | 959 | Gly & 3' His-tag added |
| ICM81 | 420 | 828 | 960 | 3' His-tag added |
| ICM82 | 421 | 829 | 961 | Gly & 3' His-tag added |
| ICM83 | 422 | 830 | 962 | Gly & 3' His-tag added |
| ICM84 | 423 | 831 | 963 | Gly & 3' His-tag added |
| ICM85 | 424 | 832 | 964 | Gly & 3' His-tag added |
| ICM86 | 425 | 833 | 965 | Gly & 3' His-tag added |
| ICM95 | 1215 | 834 | 966 | Native signal peptide removed; MetGly & 3' His-tag added |
| ICM95 | 1215 | 835 | 967 | Native signal peptide removed, replaced with pelB signal peptide in plasmid vector; MetGly & 3' His-tag added |
| ICM99 | 427 | 836 | 968 | Gly & 3' His-tag added |
| ICM111 | 1216 | 837 | 969 | Native signal peptide removed, replaced with pelB signal peptide in plasmid vector; Met & 3' His-tag added |
| ICM111 | 1216 | 838 | 970 | Native signal peptide removed; Met & 3' His-tag added |
| ICM121 | 429 | 839 | 971 | Gly & 3' His-tag added |
| ICM125 | 430 | 840 | 972 | Gly & 3' His-tag added |
| ICM146 | 431 | 841 | 973 | Gly & 3' His-tag added |
| ICM147 | 432 | 842 | 974 | Gly & 3' His-tag added |
| ICM147 | 432 | 843 | 975 | Gly & 3' His-tag added |
| ICM149 | 1217 | 844 | 976 | Native signal peptide removed, replaced with pelB signal peptide in plasmid vector; MetGly & 3' His-tag added |
| ICM149 | 1217 | 845 | 977 | Native signal peptide removed; MetGly & 3' His-tag added |
| ICM166 | 1218 | 846 | 978 | Native signal peptide removed, replaced with pelB signal peptide in plasmid vector; Met & 3' His-tag added |
| ICM166 | 1218 | 847 | 979 | Native signal peptide removed; Met & 3' His-tag added |
| ICM174 | 435 | 848 | 980 | Gly & 3' His-tag added |
| ICM191 | 436 | 849 | 981 | Gly & 3' His-tag added |
| ICM192 | 1219 | 850 | 982 | Native signal peptide removed, replaced with pelB signal peptide in plasmid vector; MetGly & 3' His-tag added |
| ICM192 | 1219 | 851 | 983 | Native signal peptide removed; MetGly & 3' His-tag added |
| ICM201 | 438 | 852 | 984 | Gly & 3' His-tag added |
| ICM207 | 439 | 853 | 985 | Gly & 3' His-tag added |
| ICM208 | 440 | 854 | 986 | 3' His-tag added |
| ICM212 | 1220 | 855 | 987 | Native signal peptide removed, replaced with pelB signal peptide in plasmid vector; MetGly & 3' His-tag added |

TABLE 25-continued

Details of Synthesized Sequences for Cloning in *E. coli*

| Gene Name | Derived polypeptide SEQ ID NO: | Modified Polyn. SEQ ID NO: | Modified Polyp. SEQ ID NO: | Modifications |
|---|---|---|---|---|
| ICM212 | 1220 | 856 | 988 | Native signal peptide removed; MetGly & 3' His-tag added |
| ICM235 | 442 | 857 | 989 | Gly & 3' His-tag added |
| ICM236 | 443 | 858 | 990 | Gly & 3' His-tag added |
| ICM246 | 444 | 859 | 991 | Gly & 3' His-tag added |
| ICM275 | 445 | 860 | 992 | Gly & 3' His-tag added |
| ICM307 | 1221 | 861 | 993 | Native signal peptide removed; Met & 3' His-tag added |
| ICM307 | 1221 | 862 | 994 | Native signal peptide removed, replaced with pelB signal peptide in plasmid vector; Met & 3' His-tag added |
| ICM313 | 447 | 863 | 995 | 3' His-tag added |
| ICM332 | 1222 | 864 | 996 | Native signal peptide removed; Met & 3' His-tag added |
| ICM332 | 1222 | 865 | 997 | Native signal peptide removed, replaced with pelB signal peptide in plasmid vector; Met & 3' His-tag added |
| ICM333 | 1223 | 866 | 998 | Native signal peptide removed; MetGly & 3' His-tag added |
| ICM333 | 1223 | 867 | 999 | Native signal peptide removed, replaced with pelB signal peptide in plasmid vector; MetGly & 3' His-tag added |
| ICM349 | 450 | 868 | 1000 | 3' His-tag added |
| ICM372 | 451 | 869 | 1001 | Gly & 3' His-tag added |
| ICM403 | 452 | 870 | 1002 | Gly & 3' His-tag added |
| ICM417 | 453 | 871 | 1003 | 3' His-tag added |
| ICM418 | 454 | 872 | 1004 | 3' His-tag added |
| ICM419 | 1224 | 873 | 1005 | Native signal peptide removed; MetGly & 3' His-tag added |
| ICM419 | 1224 | 874 | 1006 | Native signal peptide removed, replaced with pelB signal peptide in plasmid vector; MetGly & 3' His-tag added |
| ICM422 | 1225 | 875 | 1007 | Native signal peptide removed; MetGly & 3' His-tag added |
| ICM422 | 1225 | 876 | 1008 | Native signal peptide removed, replaced with pelB signal peptide in plasmid vector; MetGly & 3' His-tag added |
| ICM425 | 457 | 877 | 1009 | Gly & 3' His-tag added |
| ICM430 | 458 | 878 | 1010 | 3' His-tag added |
| ICM433 | 1226 | 879 | 1011 | Native signal peptide removed; MetGly & 3' His-tag added |
| ICM433 | 1226 | 880 | 1012 | Native signal peptide removed, replaced with pelB signal peptide in plasmid vector; MetGly & 3' His-tag added |
| ICM434 | 460 | 881 | 1013 | Gly & 3' His-tag added |
| ICM435 | 1227 | 882 | 1014 | Native signal peptide removed; MetGly & 3' His-tag added |
| ICM435 | 1227 | 883 | 1015 | Native signal peptide removed, replaced with pelB signal peptide in plasmid vector; MetGly & 3' His-tag added |
| ICM457 | 1228 | 884 | 1016 | Native signal peptide removed; Met & 3' His-tag added |
| ICM457 | 1228 | 885 | 1017 | Native signal peptide removed, replaced with pelB signal peptide in plasmid vector; Met & 3' His-tag added |
| ICM458 | 1229 | 886 | 1018 | Native signal peptide removed; MetGly & 3' His-tag added |
| ICM458 | 1229 | 887 | 1019 | Native signal peptide removed, replaced with pelB signal peptide in plasmid vector; MetGly & 3' His-tag added |
| ICM459 | 1230 | 888 | 1020 | Native signal peptide removed; MetGly & 3' His-tag added |
| ICM459 | 1230 | 889 | 1021 | Native signal peptide removed, replaced with pelB signal peptide in plasmid vector; MetGly & 3' His-tag added |
| ICM466 | 465 | 890 | 1022 | Gly & 3' His-tag added |
| ICM471 | 466 | 891 | 1023 | Gly & 3' His-tag added |

TABLE 25-continued

Details of Synthesized Sequences for Cloning in E. coli

| Gene Name | Derived polypeptide SEQ ID NO: | Modified Polyn. SEQ ID NO: | Modified Polyp. SEQ ID NO: | Modifications |
|---|---|---|---|---|
| ICM483 | 467 | 892 | 1024 | Gly & 3' His-tag added |
| ICM484 | 468 | 893 | 1025 | Gly & 3' His-tag added |
| ICM485 | 1231 | 894 | 1026 | Native signal peptide removed, replaced with pelB signal peptide in plasmid vector; Met & 3' His-tag added |
| ICM485 | 1231 | 895 | 1027 | Native signal peptide removed; Met & 3' His-tag added |
| ICM495 | 470 | 896 | 1028 | Gly & 3' His-tag added |
| ICM503 | 1232 | 897 | 1029 | Native signal peptide removed, replaced with pelB signal peptide in plasmid vector; MetGly & 3' His-tag added |
| ICM503 | 1232 | 898 | 1030 | Native signal peptide removed; MetGly & 3' His-tag added |
| ICM570 | 472 | 899 | 1031 | Gly & 3' His-tag added |
| ICM571 | 473 | 900 | 1032 | Gly & 3' His-tag added |
| ICM573 | 474 | 901 | 1033 | Gly & 3' His-tag added |
| ICM576 | 475 | 902 | 1034 | Gly & 3' His-tag added |
| ICM579 | 476 | 903 | 1035 | 3' His-tag added |
| ICM580 | 477 | 904 | 1036 | Gly & 3' His-tag added |
| ICM601 | 1233 | 905 | 1037 | Native signal peptide removed; Met & 3' His-tag added |
| ICM601 | 1233 | 906 | 1038 | Native signal peptide removed, replaced with pelB signal peptide in plasmid vector; Met & 3' His-tag added |
| ICM614 | 1234 | 907 | 1039 | Native signal peptide removed; MetGly & 3' His-tag added |
| ICM614 | 1234 | 908 | 1040 | Native signal peptide removed, replaced with pelB signal peptide in plasmid vector; MetGly & 3' His-tag added |
| ICM621 | 480 | 909 | 1041 | Gly & 3' His-tag added |
| ICM623 | 1235 | 910 | 1042 | Native signal peptide removed; Met & 3' His-tag added |
| ICM623 | 1235 | 911 | 1043 | Native signal peptide removed, replaced with pelB signal peptide in plasmid vector; Met & 3' His-tag added |
| ICM147_H5 | 482 | 912 | 1044 | Gly & 3' His-tag added |
| ICM147_H9 | 1236 | 913 | 1045 | Native signal peptide removed; Met & 3' His-tag added |
| ICM147_H9 | 1236 | 914 | 1046 | Native signal peptide removed, replaced with pelB signal peptide in plasmid vector; Met & 3' His-tag added |
| ICM147_H23 | 1237 | 915 | 1047 | Native signal peptide removed, replaced with pelB signal peptide in plasmid vector; MetGly & 3' His-tag added |
| ICM147_H23 | 1237 | 916 | 1048 | Native signal peptide removed; MetGly & 3' His-tag added |
| ICM147_H35 | 1238 | 917 | 1049 | Native signal peptide removed, replaced with pelB signal peptide in plasmid vector; Met & 3' His-tag added |
| ICM147_H35 | 1238 | 918 | 1050 | Native signal peptide removed; Met & 3' His-tag added |
| ICM147_H36 | 1239 | 919 | 1051 | Native signal peptide removed, replaced with pelB signal peptide in plasmid vector; Met & 3' His-tag added |
| ICM147_H36 | 1239 | 920 | 1052 | Native signal peptide removed; Met & 3' His-tag added |
| ICM149_H3 | 1240 | 921 | 1053 | Native signal peptide removed, replaced with pelB signal peptide in plasmid vector; MetGly & 3' His-tag added |
| ICM149_H3 | 1240 | 922 | 1054 | Native signal peptide removed; MetGly & 3' His-tag added |
| ICM162_H6 | 488 | 923 | 1055 | Gly & 3' His-tag added |
| ICM1_H1 | 489 | 924 | 1056 | Gly & 3' His-tag added |
| ICM2_H1 | 490 | 925 | 1057 | Gly & 3' His-tag added |
| ICM495_H4 | 1241 | 926 | 1058 | Native signal peptide removed; MetGly & 3' His-tag added |
| ICM86_H21 | 492 | 927 | 1059 | Gly & 3' His-tag added |
| ICM86_H22 | 1242 | 928 | 1060 | Native signal peptide removed, replaced with pelB signal peptide in plasmid vector; MetGly & 3' His-tag added |
| ICM86_H22 | 1242 | 929 | 1061 | Native signal peptide removed; MetGly & 3' His-tag added |
| ICM86_H23 | 494 | 930 | 1062 | Gly & 3' His-tag added |

TABLE 25-continued

Details of Synthesized Sequences for Cloning in *E. coli*

| Gene Name | Derived polypeptide SEQ ID NO: | Modified Polyn. SEQ ID NO: | Modified Polyp. SEQ ID NO: | Modifications |
|---|---|---|---|---|
| ICM86_H24 | 495 | 931 | 1063 | 3' His-tag added |
| ICM86_H27 | 496 | 932 | 1064 | Gly & 3' His-tag added |
| POC1 | 497 | 933 | 1065 | Gly & 3' His-tag added |
| POC99 | 498 | 934 | 1066 | Gly & 3' His-tag added |
| POC64_H1 | 1243 | 935 | 1067 | Native signal peptide removed, replaced with pelB signal peptide in plasmid vector; MetGly & 3' His-tag added |
| POC64_H1 | 1243 | 936 | 1068 | Native signal peptide removed; MetGly & 3' His-tag added |
| PUB28 | 500 | 937 | 1069 | Gly & 3' His-tag added |
| PUB81 | 1244 | 938 | 1070 | Native signal peptide removed, replaced with pelB signal peptide in plasmid vector; Met & 3' His-tag added |
| PUB85 | 1245 | 939 | 1071 | Native signal peptide removed, replaced with pelB signal peptide in plasmid vector; Met & 3' His-tag added |
| PUB103 | 1246 | 940 | 1072 | Native signal peptide removed, replaced with pelB signal peptide in plasmid vector; Met & 3' His-tag added |
| PUB103 | 1246 | 941 | 1073 | Native signal peptide removed; Met & 3' His-tag added |

Table 25: Provided are the sequence identifers of the cloned sequences of some embodiments of the invention, obtained by codon optimization for expression in *E. coli*. The modifications (e.g., removal of the native signal peptide, and/or the addition of methionine codon, or a MetGly coding sequence, and/or a 3' His-tag sequence) for expression in *E. coli* are indicated for each of the optimized sequences. "Polyn." = polynucleotide; "Polyp." = polypeptide.

Example 6: Cloning of Bacterial Genes for Expression in Plants

Genes to be expressed in *Arabidopsis*, Tomato, Soybean and Maize were synthesized by Genscript. The original sequences were modified such that the codons were optimized for protein expression in the different plants (further details are available at genscript.com/tools/codon-frequency-table) and a 6 Histidine coding sequence was inserted at the 3' end of each gene.

In cases where the original sequences already included a native signal peptide, the native signal peptide was removed and an artificial initiator Methionine was added at the 5' end of the downstream mature protein.

Genes were cloned by either recombination or restriction enzyme-based methods, resulting with some genes having glycine added at the $2^{nd}$ position (after the initiator Methionine).

*Arabidopsis* and Tomato Binary vectors

Genes introduced into *Arabidopsis* and tomato were cloned into pQT1 for attaining cytosol localization. Mature versions of the proteins (not including the signal peptide) were also cloned into pQT4 for attaining chloroplast localization. pQT1 and pQT4 are modifications of pGI, a plasmid constructed by inserting a synthetic poly-(A) signal sequence, originating from pGL3 basic plasmid vector (Promega, GenBank Accession No. U47295; nucleotides 4658-4811) into the HindIII restriction site of the binary vector (Clontech, GenBank Accession No. U12640) and by replacing GUS with GUS-Intron in the pBI101.3 backbone. In pQT1 and pQT4 the cassette between the left and right borders was inverted so the gene and its corresponding promoter became closer to the right border and the NPTII gene became closer to the left border. Both pQT1 and pQT4 contain a 35S promoter and a 5' UTR from the Tomato chloroplastic leucine aminopeptidase 2 gene (SEQ ID NO: 1293; NCBI accession number: XP_015061189). pQT4 further includes a transit peptide to the chloroplast derived from the tomato RuBisCo small subunit 2A protein RbcS-2A (NCBI accession number: P07179) (SEQ ID NOs: 1291-1292).

When stacking two expression cassettes, both cassettes were initially cloned in two separate pQT1 vectors as described before. Then, a plasmid containing one of the cassettes was linearized by PmeI (leaving blunt ends). The plasmid containing the reciprocal cassette was used as a template for PCR with the following primers: F primer: gaccatgattacgccaag, R primer: agaaaggaagggaagaaag (SEQ ID NOs:1297-1298). The amplicon was then ligated into the linearized vector, resulting in a single vector harboring two "stacked" cassettes. Sequences were verified by Sanger sequencing and restriction digests.

Soybean Binary Vectors

Genes introduced into Soybean were cloned into pZY3s for attaining cytosol localization. pZY3s is a modification of vector pZY101, where the Soybean Ubiquitin9 promoter (SEQ ID NO:1287) and TVSP terminator (SEQ ID NO:1286) were inserted. The plasmid also contains an additional multiple cloning site upstream of the first expression cassette, to enable cloning of a second expression cassette. Genes cloned into pZY3s further comprise a 5' UTR from the Tomato chloroplastic leucine aminopeptidase 2 gene (NCBI accession number: XP_015061189) (SEQ ID NO:1293) and may or may not include a transit peptide to the chloroplast derived from the *Arabidopsis* RuBisCo small subunit 2A protein, optimized for expression in soybean (SEQ ID NOs:1284-1285).

When stacking two expression cassettes, one gene was cloned into pZY3s and another—into the vector pUC57_ZY3s. Genes cloned into this plasmid are flanked by a Ubiquitin9 promoter and TVSP terminator. This cassette is in turn flanked by I-SceI restriction sites. The cassette containing the second gene was excised from pUC57_ZY3s by I-SceI digestion, and cloned into a I-SceI-linearized pZY3s already carrying the first gene, resulting in a single vector harboring two "stacked" cassettes. Sequences were verified by Sanger sequencing and restriction digests.

Maize Binary Vectors

The pTF1 and pTF2s vectors are modifications of vector pZY101.1 where a Maize Ubiquitin promoter and NOS terminator (SEQ ID NOs:1257 and 1282, respectively) were inserted. pTF2 contains additional restriction sites to allow cloning of a 2$^{nd}$ expression cassette into the vector. Genes cloned into the above further comprise a 5' UTR from the Maize RuBisCo small subunit 2A gene (SEQ ID NO: 1288) and may or may not include a transit peptide to the chloroplast derived from the same RuBisCo small subunit 2A protein, optimized for expression in maize (SEQ ID NOs: 1291-1292).

When stacking two expression cassettes, one gene was cloned into pTF2s and another—into the vector pUC57_TF2s. Genes cloned into this vector are flanked by ELF1a promoter (SEQ ID NO:1296) and NOS terminator. This cassette is in turn flanked by I-SceI restriction sites. The cassette containing the second gene was excised from pUC57_TF2s by I-SceI digestion, and cloned into I-SceI-linearized pTF2s already carrying the first gene, resulting in a single vector harboring two "stacked" cassettes. Sequences were verified by Sanger sequencing and restriction digests.

The sequence of each gene was verified by Sanger sequencing in each expression vector. All aforementioned modifications are summarized in Table 26 below.

With the optimizations and modifications described above, the synthesized sequences exhibited at least 80% global identity to the curated sequences from which they were derived.

TABLE 26

Details of Synthesized Sequences for Cloning in Plants

| Gene Name | Derived SEQ ID NO: | Host plant(s) | Modified Polyn. SEQ ID NO: | Modified Polyp. SEQ ID NO: | Modifications |
|---|---|---|---|---|---|
| ICM1 | 409 | Arabidopsis thaliana | 1074 | 1143 | 3' His-tag added |
| ICM1 | 409 | Arabidopsis thaliana | 1075 | 1144 | Chloroplast transit peptide added in vector; 3' His-tag added |
| ICM1 | 409 | Glycine max | 1076 | 1145 | 3' His-tag added; second cassette in stack |
| ICM1 | 409 | Glycine max | 1077 | 1146 | 3' His-tag added; first cassette in stack |
| ICM1 | 409 | Zea mays | 1078 | 1147 | 3' His-tag added; second cassette in stack |
| ICM2 | 410 | Arabidopsis thaliana | 1079 | 1148 | 3' His-tag added |
| ICM2 | 410 | Arabidopsis thaliana | 1080 | 1149 | Chloroplast transit peptide added in vector; 3' His-tag added |
| ICM2 | 410 | Glycine max | 1081 | 1150 | 3' His-tag added; first cassette in stack |
| ICM2 | 410 | Glycine max | 1082 | 1151 | 3' His-tag added; second cassette in stack |
| ICM2 | 410 | Zea mays | 1083 | 1152 | 3' His-tag added; first cassette in stack |
| ICM86 | 425 | Arabidopsis thaliana | 1084 | 1153 | 3' His-tag added |
| ICM86 | 425 | Arabidopsis thaliana | 1085 | 1154 | Chloroplast transit peptide added in vector; 3' His-tag added |
| ICM86 | 425 | Glycine max | 1086 | 1155 | 3' His-tag added |
| ICM86 | 425 | Glycine max | 1087 | 1156 | Arabidopsis RuBisCo small subunit SP added in vector; 3' His-tag added |
| ICM95 | 1215 | Arabidopsis thaliana | 1088 | 1157 | Native signal peptide removed; Met & 3' His-tag added |
| ICM95 | 1215 | Arabidopsis thaliana | 1089 | 1158 | Native signal peptide removed; Chloroplast transit peptide added in vector; Met & 3' His-tag added |
| ICM99 | 427 | Arabidopsis thaliana | 1090 | 1159 | Codon optimized for E.coli; Gly & 3' His-tag added |
| ICM146 | 431 | Arabidopsis thaliana | 1091 | 1160 | 3' His-tag added |
| ICM146 | 431 | Arabidopsis thaliana | 1092 | 1161 | Chloroplast transit peptide added in vector; 3' His-tag added |
| ICM147 | 432 | Arabidopsis thaliana | 1093 | 1162 | 3' His-tag added |
| ICM147 | 432 | Arabidopsis thaliana | 1094 | 1163 | Chloroplast transit peptide added in vector; 3' His-tag added |

TABLE 26-continued

Details of Synthesized Sequences for Cloning in Plants

| Gene Name | Derived SEQ ID NO: | Host plant(s) | Modified Polyn. SEQ ID NO: | Modified Polyp. SEQ ID NO: | Modifications |
|---|---|---|---|---|---|
| ICM147 | 432 | Glycine max | 1095 | 1164 | 3' His-tag added |
| ICM147 | 432 | Glycine max | 1096 | 1165 | Arabidopsis RuBisCo small subunit SP added in vector; 3' His-tag added |
| ICM149 | 1217 | Arabidopsis thaliana | 1097 | 1166 | Native signal peptide removed; Met & 3' His-tag added |
| ICM149 | 1217 | Arabidopsis thaliana | 1098 | 1167 | Native signal peptide removed; Chloroplast transit peptide added in vector; Met & 3' His-tag added |
| ICM166 | 1218 | Arabidopsis thaliana | 1099 | 1168 | Native signal peptide removed; Met & 3' His-tag added |
| ICM166 | 1218 | Arabidopsis thaliana | 1100 | 1169 | Native signal peptide removed; Chloroplast transit peptide added in vector; Met & 3' His-tag added |
| ICM201 | 438 | Arabidopsis thaliana | 1101 | 1170 | 3' His-tag added |
| ICM201 | 438 | Arabidopsis thaliana | 1102 | 1171 | Chloroplast transit peptide added in vector; 3' His-tag added |
| ICM208 | 440 | Arabidopsis thaliana | 1103 | 1172 | 3' His-tag added |
| ICM208 | 440 | Arabidopsis thaliana | 1104 | 1173 | Chloroplast transit peptide added in vector; 3' His-tag added |
| ICM235 | 442 | Arabidopsis thaliana | 1105 | 1174 | 3' His-tag added |
| ICM235 | 442 | Glycine max | 1106 | 1175 | 3' His-tag added; second cassette in stack |
| ICM235 | 442 | Glycine max | 1107 | 1176 | 3' His-tag added; first cassette in stack |
| ICM235 | 442 | Zea mays | 1108 | 1177 | 3' His-tag added; second cassette in stack |
| ICM235 | 442 | Zea mays | 1109 | 1178 | 3' His-tag added; first cassette in stack |
| ICM236 | 443 | Arabidopsis thaliana | 1110 | 1179 | 3' His-tag added |
| ICM236 | 443 | Glycine max | 1111 | 1180 | 3' His-tag added; first cassette in stack |
| ICM236 | 443 | Glycine max | 1112 | 1181 | 3' His-tag added; second cassette in stack |
| ICM236 | 443 | Zea mays | 1113 | 1182 | 3' His-tag added; first cassette in stack |
| ICM236 | 443 | Zea mays | 1114 | 1183 | 3' His-tag added; second cassette in stack |
| ICM275 | 445 | Arabidopsis thaliana | 1115 | 1184 | 3' His-tag added |
| ICM275 | 445 | Arabidopsis thaliana | 1116 | 1185 | Chloroplast transit peptide added in vector; 3' His-tag added |
| ICM333 | 1223 | Arabidopsis thaliana | 1117 | 1186 | Native signal peptide removed; Met & 3' His-tag added |
| ICM333 | 1223 | Arabidopsis thaliana | 1118 | 1187 | Native signal peptide removed; Chloroplast transit peptide added in vector; Met & 3' His-tag added |
| ICM349 | 450 | Arabidopsis thaliana | 1119 | 1188 | 3' His-tag added |
| ICM349 | 450 | Arabidopsis thaliana | 1120 | 1189 | Chloroplast transit peptide added in vector; 3' His-tag added |
| ICM495 | 470 | Arabidopsis thaliana | 1121 | 1190 | 3' His-tag added |
| ICM495 | 470 | Arabidopsis thaliana | 1122 | 1191 | Chloroplast transit peptide added in vector; 3' His-tag added |
| ICM495 | 470 | Zea mays | 1123 | 1192 | 3' His-tag added |
| ICM495 | 470 | Zea mays | 1124 | 1193 | Maize RuBisCo small subunit chloroplast SP added in vector; 3' His-tag added |

TABLE 26-continued

Details of Synthesized Sequences for Cloning in Plants

| Gene Name | Derived SEQ ID NO: | Host plant(s) | Modified Polyn. SEQ ID NO: | Modified Polyp. SEQ ID NO: | Modifications |
|---|---|---|---|---|---|
| ICM570 | 472 | Arabidopsis thaliana | 1125 | 1194 | 3' His-tag added |
| ICM570 | 472 | Arabidopsis thaliana | 1126 | 1195 | Chloroplast transit peptide added in vector; 3' His-tag added |
| ICM147_H5 | 482 | Arabidopsis thaliana | 1127 | 1196 | 3' His-tag added |
| ICM147_H5 | 482 | Arabidopsis thaliana | 1128 | 1197 | Chloroplast transit peptide added in vector; 3' His-tag added |
| ICM147_H9 | 1236 | Arabidopsis thaliana | 1129 | 1198 | Native signal peptide removed; Met & 3' His-tag added |
| ICM147_H9 | 1236 | Arabidopsis thaliana | 1130 | 1199 | Native signal peptide removed; Chloroplast transit peptide added in vector; Met & 3' His-tag added |
| ICM147_H9 | 1236 | Glycine max | 1131 | 1200 | Native signal peptide removed; Met & 3' His-tag added |
| ICM147_H9 | 1236 | Zea mays | 1132 | 1201 | Native signal peptide removed; Met & 3' His-tag added |
| ICM147_H9 | 1236 | Zea mays | 1133 | 1202 | Native signal peptide removed; Maize RuBisCo small subunit chloroplast SP added in vector; 3' His-tag added |
| ICM147_H9 | 1236 | Glycine max | 1134 | 1203 | Native signal peptide removed; Arabidopsis RuBisCo small subunit SP added in vector; 3' His-tag added |
| ICM1_H1 | 489 | Zea mays | 1135 | 1204 | 3' His-tag added; second cassette in stack |
| ICM2_H1 | 490 | Zea mays | 1136 | 1205 | 3' His-tag added; first cassette in stack |
| PUB81 | 1244 | Solarium lycopersicum | 1137 | 1206 | Native signal peptide removed; Met & 3' His-tag added |
| PUB81 | 1244 | Solarium lycopersicum | 1138 | 1207 | Native signal peptide removed; Chloroplast transit peptide added in vector; Met & 3' His-tag added |
| PUB81 | 1244 | Glycine max | 1139 | 1208 | Native signal peptide removed; Met & 3' His-tag added |
| PUB103 | 1246 | Zea mays | 1140 | 1209 | Native signal peptide removed: Maize RuBisCo small subunit chloroplast SP added in vector; 3' His-tag added |
| PUB103 | 1246 | Zea mays | 1141 | 1210 | Native signal peptide removed: Met & 3' His-tag added |
| PUB81 | 1244 | Glycine max | 1142 | 1211 | Native signal peptide removed; Arabidopsis RuBisCo small subunit SP added in vector; 3' His-tag added |

Table 26: Provided are the sequence identifers of the cloned sequences of some embodiments of the invention, obtained by codon optimization to expression in target plants. The modifications (e.g., removal of the native signal peptide, and/or the addition of methionine codon, or a MetGly coding sequence, and/or a 3' His-tag sequence) for expression in plants are indicated for each of the optimized sequences. "Polyn." = polynucleotide; "Polyp." = polypeptide.

Example 7: Protein Expression and Subsequent Purification from Bacterial Cells Transformation of Bacterial Cells with Polynucleotides Encoding the Insecticidal Polypeptides Genes encoding candidate toxin proteins of the present invention were cloned in pET22/T7-lac promoter-based vector, and coding DNA sequence was confirmed by sequencing. pET-based expression vectors were transformed into BL21(DE3) E. coli host using heat shock method. After overnight growth in Terrific Broth (TB) medium at 37° C. in the presence of Carbenicillin (100 µg/mL), 5 mL starter cultures were used to inoculate 100 mL TB culture at OD600 0.05 in 0.5 L flat bottom flask. The cultures were allowed to grow until OD600 ~0.5 (2-3 hours at 37° C. with 250 rpm). The incubator shaker temperature was reduced to 11° C., 16° C. or 22° C. and cultures were allowed to grow for another 10 minutes after which Isopropyl β-D-1-thiogalactopyranoside (IPTG) was added at final concentration of 1 mM. The cultures were incubated further for 15 to 18 hours for target protein expression and then cells were harvested by centrifuging at 4,000 rpm/4° C./10 minutes. The cell pellet was washed with cold water containing 1 mM phenylmethylsulfonyl fluoride (PMSF) and stored at −80° C. until used for protein purification.

Bacterial cell pellet was lysed using bacterial protein extraction buffer (20 mM potassium phosphate pH 8.0, 300 mM NaCl, 0.1% triton X-100, 1 mM PMSF, 20 μg/mL DNAase I, 2 mM MgCl2, 10 mM imidazole and 1 mg/mL lysozyme) at room temperature for 1 hour. The supernatant fraction (containing soluble protein) and pellet fraction (containing inclusion bodies and cell debris) of whole cell lysate were separated by centrifugation at 4,000 rpm/4° C./25 minutes.

Purification of Expressed Recombinant Pesticidal Polypeptides

Soluble fractions—The supernatant fraction containing soluble protein was incubated with Ni-NTA beads (washed with binding buffer prior to addition of supernatant fraction: 20 mM potassium phosphate pH 8.0, 300 mM NaCl and 10 mM imidazole) for 1 hour at 4° C. on a rotatory shaker with gentle shaker speed. The Ni-NTA-bound protein beads were collected by centrifugation at 1,200 rpm/4° C./5 minutes. The Ni-NTA-bound protein beads were washed with washing buffer (20 mM potassium phosphate pH 8.0, 300 mM NaCl and 20 mM imidazole) for 3 times. The bound proteins were eluted with elution buffer (20 mM potassium phosphate pH 8.0, 300 mM NaCl and 250 mM imidazole). The salts in the eluted proteins were removed using 0.5 mL Zebra Spin desalting columns equilibrated with 20 mM potassium phosphate pH 8.0. SDS-PAGE analysis was used to quantify protein using known concentrations of bovine serum albumin (BSA) as standard. Known concentrations of toxin candidates were used for bioassay.

Inclusion bodies—The pellet fraction containing inclusion bodies and cell debris was washed with 20 mM potassium phosphate pH 8.0 and 0.1% triton and then re-suspended in 20 mM potassium phosphate pH 8.0. Proteins in the inclusion bodies were quantified using 1:10 and 1:20 dilution on SDS-PAGE using known concentrations of bovine serum albumin (BSA) as standard. The known concentrations of toxin candidate in inclusion bodies were used for bioassay.

Example 8: Exposure of Insects to Diet Containing Insecticidal Proteins of the Invention The following describes the validation assays using proteins expressed in bacterial cells (Example 5 above) and provided as purified soluble proteins or inclusion bodies (Example 7 above).

Insecticidal activity of proteins—Protein samples were assayed by application to insect artificial diet in a 96-well microtiter plate format in a method known to those familiar with the art [e.g., as described in Wei J Z et al., 2018. Plant Biotechnol J 16(2):649-659; (PMID: 28796437), which is fully incorporated herein by reference]. In this procedure, 100 μl of artificial diet were added to each well of the microtiter plate prior to the application of the protein samples. The outside wells of the plate were not used in the bioassay in order to avoid edge effects. Relevant buffers served as negative and positive controls.

Protein samples were added to 10 separate wells of the 96-well plate, corresponding to wells 2-11, in rows B through F. Negative control samples were added to wells G2-G6 and positive control samples were added to wells G7-G11. 15 μl of sample solution were applied to each well of the diet. After application, the plates were held for 30-45 minutes allowing absorption/drying of excess liquid from protein samples. Plates were then infested with the insect species of interest.

In the lepidopteran insect test [including Black cutworm (BCW, *Agrotis ipsilon*); Corn earworm (CEW, *Helicoverpa zea*); Cabbage looper (CL, *Trichoplusia ni*) Egyptian cotton leafworm (CLW, *Spodoptera* littoalis); European corn borer (ECB, *Ostrinia nubilalis*) Soybean looper (SBL, *Chrysodeixis includens*) and Fall armyworm (FAW, *Spodoptera frugiperda*)], infestation was accomplished through single insect transfer using a fine camel hair brush to pick up neonate insects and place them in the test wells. In the case of Western corn rootworm (WCR, *Diabrotica virgifera virgifera*), mass infest of an average of 5 insects/well was performed. Following infestation, the plates were sealed with a microtiter plate mylar seal membrane which was then punctured above each well with a fine insect pin. The plates were then placed at the appropriate temperature incubator and held for 96 hours prior to scoring for response. Insect response was graded as normal (no response, "0"), stunting (moderate reduction in insect mass compared to negative controls, "1"), severe stunting (less than 20% the size of negative controls, "2"), or death ("3"). The 10 repeats were scored and analyzed by Fisher's exact test to determine differences between treatments and negative control. Grading was comparative to control scores, produced with buffer-only negative control treatments.

A selection of insecticidal active proteins was further taken for $IC_{50}$ and $LC_{50}$ determinations, using a method known to those familiar with the art. In short, protein samples, along with the relevant buffer negative control and positive control, were serially diluted by 1:2. A typical dilution series includes 1 mg/ml, 0.5 mg/ml, 0.25 mg/ml, 0.125 mg/ml, and 0.062 mg/ml.

100 repeats (10 for each concentration) were scored. The scores were then translated to two binary variables:

Inhibition: 0→0, 1-3→1.

Death: 0-2→0; 3→1.

GLM (Generalized Linear Model) analysis was then applied to separately model these two variables by $\log_{10}$ of the concentrations. $IC_{50}$ and $LC_{50}$ were extracted from these models using reverse prediction. The $IC_{50}$ is defined as the concentration of sample necessary to cause 50% of the test organisms to respond with a stunted phenotype after exposure to the sample and is extracted from the model of the Inhibition variable. $LC_{50}$ is defined as the concentration of sample necessary to cause 50% of the test organisms to die after exposure to the sample and is extracted from the model of the Death variable.

Tables 27-28 summarize the observed insecticidal activity of polypeptides of some embodiments of the invention on various insect species, and the $IC_{50}$ and $LC_{50}$ values of several insecticidal polypeptides.

TABLE 27

Effect of the insecticidal polypeptides of the invention on several insect species

| Gene name | Fraction | Target Insect | Conc. (ppm) | Mean | Median | Mode | P-value |
|---|---|---|---|---|---|---|---|
| ICM11 | Inclusion | FAW | <50 | 2.6 | 3 | 3 | 0.009 |
| ICM111 | Soluble | CLW | 2900 | 1.2 | 1 | 1 | 0.041 |
| ICM121 | Soluble | CLW | 470 | 1.3 | 2 | 2 | 0.032 |
| ICM146 | Inclusion | SBL | 2900 | 2.1 | 2 | 2 | L |
| ICM147 | Soluble | CEW | 750 | 1.3 | 1 | 1 | L |
| ICM147 | Soluble | CL | 2000 | 2.7 | 3 | 3 | L |
| ICM147 | Soluble | FAW | 2000 | 2 | 2.5 | 3 | L |
| ICM147 | Soluble | SBL | 500 | 2.9 | 3 | 3 | L |
| ICM147_H23 | Inclusion | FAW | <50 | 1.3 | 2 | 2 | 0.005 |
| ICM147_H35 | Inclusion | FAW | 300 | 1.6 | 1 | 1 | 0.019 |
| ICM147_H36 | Inclusion | FAW | 500 | 1.44 | 1 | 1 | 0.022 |
| ICM147_H5 | Soluble | BCW | 2000 | 1 | 1 | 0 | 0.021 |
| ICM147_H5 | Soluble | CEW | 2000 | 1 | 1 | 1 | L |
| ICM147_H5 | Soluble | FAW | 2200 | 1.4 | 1.5 | 2 | 0.029 |
| ICM147_H5 | Soluble | SBL | 1750 | 2.2 | 3 | 3 | L |
| ICM147_H9 | Soluble | CEW | 1750 | 2.2 | 2.5 | 3 | L |
| ICM147_H9 | Soluble | CL | 1000 | 2.4 | 3 | 3 | 0.003 |
| ICM147_H9 | Soluble | FAW | 2500 | 2.7 | 3 | 3 | 0.004 |
| ICM147_H9 | Soluble | SBL | 1500 | 2.4 | 3 | 3 | L |
| ICM149 | Inclusion | FAW | 2500 | 1.3 | 1.5 | 2 | 0.038 |
| ICM149_H3 | Inclusion | CL | 3700 | 2.9 | 3 | 3 | 0.011 |
| ICM15 | Inclusion | FAW | 1500 | 2.6 | 3 | 3 | 0.009 |
| ICM162_H6 | Inclusion | SBL | 350 | 1.3 | 1 | 0 | 0.030 |
| ICM166 | Inclusion | SBL | 1480 | 1.6 | 2 | 2 | L |
| ICM174 | Inclusion | SBL | 5200 | 1.4 | 1 | 1 | L |
| ICM201 | Inclusion | SBL | 100 | 1.6 | 2 | 2 | 0.003 |
| ICM207 | Inclusion | SBL | 1640 | 1.9 | 2 | 2 | L |
| ICM212 | Inclusion | FAW | 1700 | 1.4 | 1 | 1 | 0.031 |
| ICM23 | Inclusion | SBL | <50 | 1.2 | 1 | 1 | L |
| ICM246 | Soluble | CLW | 1800 | 1.2 | 2 | 3 | 0.051 |
| ICM275 | Soluble | WCR | 100 | 2.4 | 2 | 2 | L |
| ICM307 | Inclusion | CEW | <50 | 1.2 | 1 | 1 | L |
| ICM307 | Inclusion | FAW | <50 | 1.6 | 1 | 1 | 0.009 |
| ICM307 | Inclusion | SBL | <50 | 1.67 | 2 | 2 | L |
| ICM313 | Inclusion | SBL | 250 | 1.22 | 1 | 1 | 0.002 |
| ICM332 | Inclusion | SBL | <50 | 1.78 | 2 | 2 | 0.003 |
| ICM333 | Inclusion | SBL | 500 | 3 | 3 | 3 | L |
| ICM333 | Inclusion | WCR | 500 | 3 | 3 | 3 | L |
| ICM349 | Inclusion | CLW | 600 | 2.2 | 2 | 2 | L |
| ICM372 | Soluble | CLW | 270 | 1.2 | 1 | 0 | 0.028 |
| ICM403 | Inclusion | SBL | 300 | 1.3 | 1 | 1 | 0.007 |
| ICM417 | Inclusion | SBL | 1500 | 1.5 | 2 | 2 | 0.001 |
| ICM418 | Inclusion | SBL | 1100 | 1.4 | 1 | 1 | L |
| ICM419 | Inclusion | SBL | <50 | 1.5 | 2 | 2 | L |
| ICM422 | Inclusion | SBL | <50 | 1.33 | 1 | 1 | L |
| ICM425 | Inclusion | SBL | <50 | 1.33 | 2 | 2 | 0.013 |
| ICM430 | Inclusion | SBL | <50 | 1.6 | 2 | 2 | 0.006 |
| ICM433 | Inclusion | SBL | <50 | 1.44 | 1 | 1 | 0.025 |
| ICM434 | Inclusion | SBL | <50 | 1.44 | 1 | 1 | 0.025 |
| ICM435 | Inclusion | SBL | 100 | 1.5 | 1.5 | 1 | 0.017 |
| ICM459 | Inclusion | SBL | 300 | 3 | 3 | 3 | L |
| ICM459 | Inclusion | WCR | 300 | 3 | 3 | 3 | L |
| ICM466 | Inclusion | SBL | 2500 | 1.3 | 1 | 1 | 0.002 |
| ICM471 | Inclusion | SBL | 2300 | 1.3 | 1 | 1 | L |
| ICM483 | Inclusion | SBL | 2000 | 1.2 | 1 | 1 | L |
| ICM484 | Inclusion | SBL | 1500 | 1.2 | 1 | 1 | 0.011 |
| ICM485 | Inclusion | SBL | 2500 | 1.2 | 1 | 1 | 0.011 |
| ICM49 | Inclusion | FAW | 1500 | 2.4 | 3 | 3 | 0.039 |
| ICM495 | Soluble | WCR | 550 | 2.89 | 3 | 3 | L |
| ICM495_H4 | Inclusion | FAW | 4000 | 1.5 | 1 | 3 | 0.020 |
| ICM503 | Inclusion | FAW | 3000 | 1.9 | 2 | 2 | 0.010 |
| ICM57 | Inclusion | CLW | 2900 | 2.1 | 3 | 3 | 0.015 |
| ICM570 | Soluble | CLW | 950 | 2.2 | 3 | 3 | 0.001 |
| ICM60 | Inclusion | SBL | 2030 | 1.5 | 1.5 | 1 | L |
| ICM601 | Inclusion | FAW | <50 | 1.2 | 1 | 1 | 0.031 |
| ICM614 | Inclusion | FAW | <50 | 2.2 | 2 | 2 | 0.023 |
| ICM621 | Inclusion | FAW | <50 | 1.9 | 2 | 2 | 0.030 |
| ICM623 | Inclusion | FAW | 300 | 1.2 | 1.5 | 2 | 0.025 |
| ICM64 | Inclusion | SBL | 750 | 1.3 | 1 | 1 | 0.035 |
| ICM73 | Inclusion | SBL | 300 | 1.3 | 1 | 1 | 0.015 |
| ICM81 | Soluble | SBL | <50 | 1.9 | 2 | 3 | 0.005 |
| ICM86 | Inclusion | CL | 850 | 2.3 | 2 | 2 | L |
| ICM86 | Inclusion | ECB | 3600 | 1.7 | 2 | 2 | L |
| ICM86 | Inclusion | FAW | 750 | 1.8 | 2 | 2 | 0.001 |
| ICM86 | Inclusion | SBL | 2300 | 2 | 2 | 2 | L |
| ICM86_H21 | Inclusion | FAW | <50 | 1.5 | 1 | 1 | 0.004 |
| ICM86_H22 | Inclusion | FAW | <50 | 1.9 | 2 | 1 | 0.009 |
| ICM86_H23 | Inclusion | FAW | <50 | 1.3 | 1 | 1 | 0.004 |
| ICM86_H24 | Inclusion | FAW | <50 | 1.4 | 1 | 1 | 0.001 |
| ICM86_H27 | Soluble | CEW | 300 | 1.2 | 1 | 1 | L |
| ICM95 | Inclusion | CL | 1000 | 1.3 | 1 | 1 | 0.025 |
| ICM95 | Inclusion | FAW | 1500 | 1.3 | 1 | 1 | 0.022 |
| ICM95 | Inclusion | SBL | 1500 | 1.2 | 1 | 1 | L |
| ICM99 | Inclusion | FAW | <50 | 1.9 | 2 | 2 | 0.002 |
| ICM99 | Inclusion | SBL | <50 | 2 | 2 | 2 | L |
| POC1 | Soluble | CLW | 1770 | 1.5 | 2 | 0 | 0.002 |
| P0C99 | Inclusion | SBL | 100 | 1.3 | 1 | 1 | L |
| PUB103 | Soluble | WCR | 1800 | 1.8 | 2 | 2 | L |
| PUB28 | Inclusion | CLW | 1700 | 2.3 | 3 | 3 | 0.015 |
| PUB81 | Inclusion | CLW | 400 | 1.9 | 3 | 3 | 0.032 |
| PUB85 | Inclusion | CLW | 550 | 2.2 | 3 | 3 | 0.004 |

Table 27: The concentration of the insecticidal protein used in each assay is given as "parts per million" (ppm), and the response to the insecticidal protein (mean, median and mode) is graded from "0" (no response of the toxin on the insect); stunting (moderate reduction in insect mass compared to negative controls, "1"), severe stunting (less than 20% the size of negative controls, "2"), or death ("3"). Effect is compared to negative control treatments (respective buffer of purified soluble proteins and inclusion bodies) and significant reduction in survival or impaired development is reflected by the P-value. "Mean"-the mean score; "Median" -the median score; and "mode" -the most frequent value; "L" = p-value <0.001

TABLE 28

$IC_{50}$ and $LC_{50}$ results of the above assays

| Protein Data | | | $IC_{50}$ | | $LC_{50}$ | |
|---|---|---|---|---|---|---|
| Gene Name | Fraction | Target Insect | Calculated (ppm) | Goodness of Fit | Calculated (ppm) | Goodness of Fit |
| ICM146 | Inclusion | SBL | 866 | 0.9258 | — | — |
| ICM147 | Soluble | CL | 44 | 0.9874 | 220 | 0.9997 |
| ICM147 | Soluble | FAW | 82 | 1 | — | — |
| ICM147 | Soluble | SBL | 30 | 0.9808 | 564 | 0.9526 |
| ICM147_H5 | Soluble | SBL | — | — | 762 | 0.9978 |
| ICM147_H9 | Soluble | CEW | 1423 | 0.9622 | — | — |
| ICM147_H9 | Soluble | FAW | 97 | 0.9168 | 1349 | 0.625 |
| ICM147_H9 | Soluble | SBL | 420 | 0.9975 | 1120 | 0.9979 |
| ICM333 | Inclusion | SBL | 297 | 0.9995 | — | — |
| ICM495 | Soluble | WCR | 18 | 0.9963 | 589 | 1 |
| ICM57 | Soluble | CLW | 3327 | 0.5995 | — | — |
| ICM570 | Soluble | CLW | 442 | 0.9233 | 1767 | 1 |

TABLE 28-continued

IC$_{50}$ and LC$_{50}$ results of the above assays

| Protein Data | | | IC$_{50}$ | | LC$_{50}$ | |
|---|---|---|---|---|---|---|
| Gene Name | Fraction | Target Insect | Calculated (ppm) | Goodness of Fit | Calculated (ppm) | Goodness of Fit |
| ICM86 | Inclusion | ECB | 74 | 0.997 | — | — |
| ICM86 | Inclusion | FAW | 20 | 0.4309 | — | — |
| ICM86 | Inclusion | SBL | 93 | 1 | — | — |
| POC99 | Inclusion | SBL | 126 | 0.9996 | — | — |

Table 28: The calculated concentration of the protein (in parts per million (ppm)) inhibiting the development of (IC$_{50}$) or being lethal to (LC$_{50}$) 50% of the insect population; and the corresponding goodness of fit values.

Example 9: Exposure of Stink but to Diet Containing Insecticidal Proteins of the Invention In an additional type of assay, the ability of proteins of the invention to kill or inhibit the development of the southern green stink bug (*Nezara viridula*) was examined by incorporating the proteins to the insect diet as described hereinbelow.

Five 2$^{nd}$ instar nymphs were added to a 30 ml plastic condiment cup. Insects were contained in the cup by a thinly stretched piece of Parafilm. The protein samples and artificial diet (Frontier Scientific) were applied to the Parafilm surface and then a second layer of Parafilm added to enclose the protein sample and diet. Insects were allowed to feed for 96 hours before evaluation. After 96 hours the insects were graded as alive or dead (insects which were unable to right themselves were considered moribund and were counted as "dead"). This assay was conducted in 5 separate repeats. At the end of the assay, live insects were collected into 200 µl of ethanol in 2 ml microcentrifuge tubes. Tubes were dried at 37° C. for ~5 days before being weighed. Corrected average weight was calculated as total weight (mg)/5 (effectively giving dead larvae a weight of 0 mg). Mean comparisons between tested and control treatments were conducted using a one-way ANOVA (Dunnett's test) with a buffer sample as the control.

A selection of bioactive proteins was taken for LC$_{50}$ and IC$_{50}$ determinations, as follows: Protein samples, along with the relevant buffer negative control and positive controls, were serially diluted as described hereinabove (Example 8). GLM analysis was applied to the corrected average weight calculated for each treatment. The LC$_{50}$ was defined as the concentration of sample necessary to cause 50% of the test organisms to die after exposure to the sample and was extracted from the model of the Death variable. The IC$_{50}$ is defined as the concentration of sample necessary to cause 50% reduction in corrected average weight compared to the control treatment and is extracted from the model of the Stunting variable.

A further assay is used to qualify the ability of the proteins to inhibit egg hatch or nymphal development of stink bugs. Protein samples are assayed by applying the samples directly to stink bug egg masses. For each replicate, egg masses from a single female (which typically contain 70-100 eggs) are split into sections depending on the number of treatments. Each egg section is placed on top of an absorbent cotton wick in a 30 ml plastic condiment cup. The protein sample/control sample is applied directly to the egg mass/wick until saturation (wick was slightly shiny). Cups are sealed using a solid plastic lid. Egg masses are observed daily for hatching and nymph survival/mortality. Insects are graded as alive or dead (insects which are unable to flip themselves upright are considered moribund and are counted as dead). Daily sampling continues until all of the insects in control treatments have molted to the 2nd instar. Mean comparisons are conducted using a one-way ANOVA (Dunnett's test) with a buffer sample as the control.

Table 29 summarizes the effect of the polypeptides on Stink bug nymphs.

TABLE 29

Effect of polypeptides of the invention on the development and survival of Southern green stink bug (STK, Nezara viridula)

| | | | STK | | | |
|---|---|---|---|---|---|---|
| Gene name | Fraction | Concentration (PPM) | Mean | Median | Mode | P-value |
| ICM111 | Soluble | 330 | 4.4 | 4 | 4 | 0.040 |
| ICM125 | Soluble | 206 | 2 | 2 | 1 | 0.008 |
| ICM149_H3 | Inclusion | 1800 | 4.2 | 4 | 4 | 0.026 |
| ICM191 | Inclusion | 800 | 0.4* | 0.45* | 0* | 0.004 |
| ICM192 | Inclusion | 1380 | 3 | 3 | 4 | L |
| ICM208 | Inclusion | 2250 | 0.26* | 0.25* | 0* | L |
| ICM212 | Inclusion | 3800 | 0.334* | 0.324* | 0* | L |
| ICM495 | Soluble | 3415 | 2.4 | 2 | 5 | 0.002 |
| ICM571 | Inclusion | 1700 | 3.8 | 4 | 4 | L |
| ICM573 | Inclusion | 50> | 3.8 | 4 | 5 | L |
| ICM576 | Inclusion | 600 | 4 | 4 | 4 | L |
| ICM579 | Inclusion | 2100 | 3.4 | 4 | 5 | L |
| ICM580 | Inclusion | 2600 | 4.2 | 4 | 5 | L |
| POC64_H1 | Inclusion | 900 | 0.519* | 0.562* | 0* | 0.122 |
| PUB81 | Soluble | 490 | 2.4 | 3 | 3 | 0.076 |
| PUB85 | Inclusion | 130 | 3.4 | 3 | 3 | 0.086 |

Table 29: Gene names = recombinant polypeptides as per Table 25 hereinabove, isolated from transformed bacteria expressing same. The concentration of the protein used in each assay is given as "parts per million" (ppm), and the response to the protein (mean, median and mode) is reflected either by survival data (0-5 scale, where 0 indicates no survivors and 5-complete survival), or weight data (given in mg and marked by an asterisk (*)). In both cases protein effect is compared to negative control treatments and significant reduction in survival or weight gain is reflected by the P-value.
"Polyp." = polypeptide. "Mean" -the mean score; "Median" -the median score; and "mode" -the most frequent value. "L" -P < 0.001

TABLE 30

LC$_{50}$ results of the above assay

| Protein Data | | LC$_{50}$ | |
|---|---|---|---|
| Gene Name | Fraction | Calculated (ppm) | Goodness of Fit |
| ICM125 | Soluble | 109 | 0.24 |
| PUB81 | Soluble | 878 | 0.45 |

Table 30: The calculated concentration of the toxin (in parts per million (ppm)) being lethal to (LC$_{50}$) 50% of the insect population; and the corresponding goodness of fit values.

Example 10: Identification of Insecticidal Complexes

Genes positioned in a tandem orientation on the same DNA strand in the bacterial genome, separated by gaps of 34-40 bp, are predicted by the inventors of the present invention to be expressed as operons in a polycistronic manner. As is known in the art (e.g. Bergman N H., et al. Appl Environ Microbiol. 2007, 73(3): 846-54), some operons may contain larger gaps between genes and, therefore, orthologues of genes associated with an operon by the aforementioned criteria, found to be adjacent to orthologues of other genes associated with the same operon, were also regarded by the present inventors as belonging to an operon module, even in cases where the distance between them exceeded 40 bp. For instance, ICM1 (SEQ ID NO:1) and ICM2 (SEQ ID NO:2) are considered to form an operon as they are positioned in the same orientation and are separated by a 21 bp-long gap. The corresponding orthologues ICM1_H1 (SEQ ID NO:81) and ICM2_H1 (SEQ ID NO:82) are also considered to form an operon although they are separated by a 209 bp-long gap.

Bacterial genes encoded in operons may function together by playing a role in the same circuitry, or by physically interacting with each other. In some cases, redundancy within an operon also grants phenotypic plasticity. Insecticidal binary and ternary heterocomplexes encoded in operons were previously described in the art (e.g., as discussed in French-Constant R H et al., 2007. Toxicon. 49(4): 436-51. "Insecticidal toxins from *Photorhabdus* bacteria and their potential use in agriculture"). Therefore, the present inventors tested combinations of candidate proteins originating from the same bacterial operons.

Tables 31-32 show the results of binary toxins, ternary toxins and separate subunits, which were cloned, isolated and evaluated as described hereinabove (Examples 5, 7 and 8). For some of the insect pests listed below, the binary and ternary toxins—but not their individual subunits—display the insecticidal activity.

TABLE 31

Effect of the insecticidal binary and ternary systems, and separate subunits, on insect development and/or survival.

| Gene Name(s) | Fraction | Target Insect | Conc. (ppm) | Mean | Median | Mode | P-value |
|---|---|---|---|---|---|---|---|
| ICM1_H1 + ICM2_H1 | Soluble | WCR | 4 | 2.3 | 2 | 2 | L |
| ICM1 + ICM2 | Soluble | BCW | 1980 | 3 | 3 | 3 | L |
| ICM1 + ICM2 | Soluble | CEW | 1980 | 2.1 | 2 | 2 | L |
| ICM1 + ICM2 | Soluble | CL | 400 | 3 | 3 | 3 | L |
| ICM1 + ICM2 | Inclusion | CLW | 3020 | 1.5 | 1.5 | 0 | 0.030 |
| ICM1 + ICM2 | Soluble | ECB | 260 | 2 | 2 | 1 | L |
| ICM1 + ICM2 | Soluble | FAW | 1980 | 3 | 3 | 3 | L |
| ICM1 + ICM2 | Soluble | SBL | 600 | 2.1 | 2 | 3 | L |
| ICM235 + ICM236 | Soluble + Inclusion | BCW | 3500 | 3 | 3 | 3 | L |
| ICM235 + ICM236 | Soluble + Inclusion | CLW | 3500 | 2.7 | 3 | 3 | L |
| ICM235 + ICM236 | Inclusion | ECB | 2000 | 3 | 3 | 3 | L |
| ICM235 + ICM236 | Soluble+ Inclusion | FAW | 3500 | 1.1 | 1 | 1 | L |
| ICM457 + ICM458 + ICM459 | Inclusion | FAW | <50 | 1.5 | 1 | 1 | 0.009 |
| ICM457 + ICM458 + ICM459 | Inclusion | STK | 166 | 1.4 | 1 | 0 | 0.036 |
| ICM73 + ICM74 | Soluble | BCW | 1000 | 1.4 | 1.5 | 2 | L |
| ICM73 + ICM74 | Soluble | CLW | 1000 | 1.2 | 1 | 1 | L |
| ICM73 + ICM74 | Soluble | FAW | 1000 | 1.11 | 1 | 1 | L |
| ICM82 + ICM83 | Soluble | BCW | 60 | 0.9 | 1 | 0 | 0.131 |
| ICM82 + ICM83 | Soluble | CEW | 60 | 1.2 | 1 | 1 | L |
| ICM82 + ICM83 | Soluble | CLW | 1475 | 1.2 | 1 | 0 | 0.011 |
| ICM82 + ICM83 | Soluble | FAW | 60 | 1.1 | 1 | 1 | L |
| ICM84 + ICM85 | Inclusion | CLW | 4425 | 1.6 | 2 | 2 | 0.025 |
| ICM1 | Inclusion | CLW | 830 | 0.8 | 0 | 0 | 0.060 |
| ICM1_H1 | Soluble | WCR | 75 | 0.29 | 0 | 0 | 0.180 |
| ICM2 | Inclusion | CLW | 7000 | 0.5 | 0 | 0 | 0.720 |
| ICM2_H1 | Soluble | WCR | 200 | 0.3 | 0 | 0 | 0.210 |
| ICM235 | Soluble | CEW | 5000 | 0.2 | 0 | 0 | 1.000 |
| ICM235 | Soluble | CLW | 4770 | 0.2 | 0 | 0 | 0.720 |
| ICM235 | Soluble | ECB | 4000 | 0 | 0 | 0 | 1.000 |
| ICM235 | Soluble | FAW | 4000 | 0 | 0 | 0 | 1.000 |
| ICM236 | Inclusion | CEW | 750 | 0.5 | 0 | 0 | 1.000 |
| ICM236 | Inclusion | CLW | 1827 | 0.6 | 0 | 0 | 1.000 |
| ICM236 | Inclusion | ECB | 1600 | 0.2 | 0 | 0 | 0.250 |
| ICM236 | Inclusion | FAW | 750 | 0.4 | 0 | 0 | 1.000 |
| ICM236 | Inclusion | SBL | 375 | 0.1 | 0 | 0 | 1.000 |
| ICM457 | Inclusion | FAW | 130 | 0.4 | 0 | 0 | 0.300 |
| ICM458 | Soluble | FAW | 900 | 0.8 | 1 | 1 | 0.650 |
| ICM459 | Inclusion | FAW | 2200 | 0.4 | 0 | 0 | 1.000 |
| ICM459 | Inclusion | SBL | 300 | 3 | 3 | 3 | L |
| ICM459 | Inclusion | WCR | 300 | 3 | 3 | 3 | L |
| ICM73 | Inclusion | FAW | 37 | 0.6 | 0 | 0 | 0.520 |
| ICM73 | Inclusion | SBL | 300 | 1.3 | 1 | 1 | 0.020 |
| ICM82 | Soluble | CLW | 3530 | 0.2 | 0 | 0 | 1.000 |

TABLE 31-continued

Effect of the insecticidal binary and ternary systems, and separate subunits, on insect development and/or survival.

| Gene Name(s) | Fraction | Target Insect | Conc. (ppm) | Mean | Median | Mode | P-value |
|---|---|---|---|---|---|---|---|
| ICM83 | Soluble | CEW | 150 | 0 | 0 | 0 | 1.000 |
| ICM83 | Soluble | CLW | 1200 | 0 | 0 | 0 | 1.000 |
| ICM83 | Soluble | FAW | 150 | 0.3 | 0 | 0 | 1.000 |
| ICM84 | Soluble | CLW | 3230 | 0.3 | 0 | 0 | 1.000 |
| ICM85 | Inclusion | CLW | 530 | 0.4 | 0 | 0 | 0.470 |

Table 31: The concentration of the protein used in each assay is given as "parts per million" (ppm), and the response to the protein (mean, median and mode) is graded from "0" to "3" as described in example 8. "Conc." -concentration; "Mean" -the mean score; "Median" -the median score; and "mode" -the most frequent value; "L" -P <0.001

TABLE 32

$IC_{50}$ and $LC_{50}$ results of the above assays

| Protein Data | | | $IC_{50}$ | | $LC_{50}$ | |
|---|---|---|---|---|---|---|
| Gene Name(s) | Fraction | Target Insect | Calculated (ppm) | Goodness of Fit | Calculated (ppm) | Goodness of Fit |
| ICM 1_H1 + ICM2_H1 | Soluble | WCR | 48 | 1 | 320 | 0.97 |
| ICM1 + ICM2 | Soluble | BCW | 172 | 0.9973 | — | — |
| ICM1 + ICM2 | Soluble | CEW | 21 | 1 | — | — |
| ICM1 + ICM2 | Soluble | CL | 37 | 1 | 11 | 0.9883 |
| ICM1 + ICM2 | Soluble | ECB | 43 | 0.949 | 285.91 | 1 |
| ICM1 + ICM2 | Soluble | FAW | 75 | 0.7836 | — | — |
| ICM1 + ICM2 | Soluble | SBL | 31 | 1 | — | — |
| ICM235 + ICM236 | Soluble + Inclusion | BCW | 42 | 0.2537 | 36 | 0.563 |
| ICM235 + ICM236 | Soluble + Inclusion | CEW | 67 | 0.7592 | 1953 | 0.928 |
| ICM235 + ICM236 | Soluble + Inclusion | ECB | 24 | 0.4566 | 94 | 0.5281 |
| ICM235 + ICM236 | Soluble + Inclusion | FAW | 212 | 0.7692 | 431 | 0.8646 |

Table 32: The calculated concentration of the binary toxin (in parts per million (ppm)) inhibiting the development of ($IC_{50}$) or being lethal to ($LC_{50}$) 50% of the insect population; and the corresponding goodness of fit values.

Example 11: Activity Against Bt-Resistant Insect Populations

Topical protein plate assays were further executed and analyzed as described in Example 8 for a subset of said toxins that were purified and comparably screened against insect populations that were either resistant or susceptible to commercially-used Bt toxins. Dose response assays with Cry1F-resistant FAW, Cry3Bb1-resistant WCR or *Bacillus thuringiensis* kurstaki (Btk)-resistant DiamondBack Moth, *Plutella xylostella* (DBM), unaffected by Cry1Aa, Cry1Ab, Cry1Ac, Cry2Aa and Cry2Ab, were compared with dose response assays conducted with the corresponding, Bt toxin-susceptible FAW, WCR and DBM populations by performing Probit analysis with the dose, the insect population and the interaction between them as predictors. Proteins demonstrating similar effect on both populations by having insignificant P-Value of insect population predictor in Probit analysis (>0.05) were effectively proven to have Modes of Action (MoAs) different from those of the commercial insect control products. Table 33 summarizes these comparative dose response assays.

TABLE 33

Effect of the insecticidal polypeptides of the invention on insects resistant or susceptible to commercially-used Bt toxins.

| Protein Data | | | Resistant Population | | | | Susceptible Population | | | | Probit P-Value | |
|---|---|---|---|---|---|---|---|---|---|---|---|---|
| | | | $IC_{50}$ | | $LC_{50}$ | | $IC_{50}$ | | $LC_{50}$ | | | |
| Gene Name | Fraction | Insect | Calculated (ppm) | Goodness of Fit | Calculated (ppm) | Goodness of Fit | Calculated (ppm) | Goodness of Fit | Calculated (ppm) | Goodness of Fit | $IC_{50}$ | $LC_{50}$ |
| ICM1 + ICM2 | Soluble | DBM | 6.32 | 1 | 43.78 | 0.9 | 8.95 | 1 | 69.17 | 0.01 | 0.65 | 0.74 |
| ICM235 + ICM236 | Soluble + Inclusion | DBM | 6.15 | 1 | 6.47 | 1 | 7.32 | 1 | 12.67 | 0.92 | 0.84 | 0.84 |

TABLE 33-continued

Effect of the insecticidal polypeptides of the invention on insects resistant or susceptible to commercially-used Bt toxins.

| Protein Data | | | Resistant Population | | | | Susceptible Population | | | | Probit P-Value | |
|---|---|---|---|---|---|---|---|---|---|---|---|---|
| | | | $IC_{50}$ | | $LC_{50}$ | | $IC_{50}$ | | $LC_{50}$ | | | |
| Gene Name | Fraction | Insect | Cal- culated (ppm) | Good- ness of Fit | Cal- culated (ppm) | Good- ness of Fit | Cal- culated (ppm) | Good- ness of Fit | Cal- culated (ppm) | Good- ness of Fit | $IC_{50}$ | $LC_{50}$ |
| ICM235 + ICM236 | Soluble + Inclusion | FAW | 66.45 | 0.09 | 1002.27 | 0.00002 | 23.89 | 0.58 | 778.06 | 0.44 | 0.2 | 0.34 |
| ICM86 | Inclusion | FAW | 0.13 | 0.55 | — | — | 6.04 | 1 | — | — | 0.35 | — |
| ICM1_H1 + ICM2_H1 | Soluble | WCR | 52.55 | 0.02 | — | — | 39.38 | 0.01 | — | — | 0.64 | — |
| ICM495 | Soluble | WCR | 57.26 | 0.26 | — | — | 58.48 | 0.68 | — | — | 0.52 | — |

Table 33: $IC_{50}$ and $LC_{50}$ are the calculated concentrations of the insecticidal protein (in parts per million (ppm)) inhibiting the development of or being lethal to 50% of the insect population, respectively; Results are accompanied by the goodness of fit P-value (Goodness of Fit) and the P-Value of insect population predictor in Probit analysis (Probit P-value).

Example 12: Production of Transgenic *Arabidopsis* Plants Expressing Selected Genes According to Some Embodiments of the Invention Plant transformation—The *Arabidopsis thaliana* var Columbia (To plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (C010) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the genes of some embodiments of the invention were cultured in YEBS medium (Yeast extract 1 gr/L, Beef extract 5 gr/L, $MgSO_4*7H_2O$, Bacto peptone 5 gr/L) supplemented with kanamycin (50 mg/L) and gentamycin (50 mg/L). The cultures were incubated at 28° C. for 48 hours under vigorous shaking to desired optical density at 600 nm of 0.85 to 1.1. Before transformation into plants, 60 µl of Silwet L-77 was added into 300 ml of the *Agrobacterium* suspension.

Transformation of $T_0$ plants was performed by inverting each plant into an *Agrobacterium* suspension such that the above ground plant tissue was submerged for 1 minute. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes of some embodiments of the invention, seeds collected from transgenic $T_0$ plants were surface-sterilized by exposing to chlorine fumes (6% sodium hypochlorite with 1.3% HCl) for 100 minutes. The surface-sterilized seeds were sown on culture plates containing half-strength Murashig-Skoog (Duchefa); 2% sucrose; 0.5% plant agar; 50 mg/L kanamycin; and 200 mg/L carbenicylin (Duchefa). The culture plates were incubated at 4° C. for 48 hours and then were transferred to a growth room at 25° C. for three weeks. Following incubation, the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as T2 plants under the same conditions as used for culturing and growing the $T_1$ plants.

Example 13: Production of Transgenic Tomato Plants Expressing Selected Genes According to Some Embodiments of the Invention Plant transformation—Cotyledons of *Solanum lycopersicum* var M82 were transformed using *Agrobacterium*-mediated transformation method described below.

Seeds of *Solanum lycopersicum* var M82 were surface sterilized using 3% sodium hypochlorite for 10 minutes followed by three washes by sterile distilled deionized water for 10 minutes each. Sterile seeds were sown in magenta boxes containing half-strength Murashige-Skoog (MS) salts including B5 vitamins); 2% sucrose; 0.5% plant agar. After 7 days of growth were prepared explants from cotyledons for transformation. Cotyledons were detached from the stems, cut in half, wounded and placed on the culture plates containing pre-cultivation media (MS salts and vitamins, 3% sucrose, 0.08% casein hydrolizate, 0.02% $KH_2PO_4$, 2 mg/l glycine, 0.5 mg/l biotin, 0.5 mg/l folic acid, 0.65% plant agar, 0.01 mg/l kinetin, 0.2 mg/l2,4-D, 100 µM Acetosyringone, pH=5.8). Plates were incubated in dark at 24° C. for 24 hours prior transformation.

Single colonies of *Agrobacterium* carrying the binary vectors harboring the genes of some embodiments of the invention were cultured in LB medium (Hylabs #BP302) supplemented with 50 mg/l Kanamycin and 50 mg/l carbenicillin. The cultures were incubated at 28° C. for 24 hours under vigorous shaking and diluted to the desired optical density of 0.4 to 0.5 at 600 nm into transformation medium (MS salts including B5 vitamins, 3% sucrose, 100 µM Acetosyringone, 10 mM magnesium chloride, 10 mM MES, pH 5.8).

Transformation was performed by pouring an *Agrobacterium* suspension on the cotyledons for 50 minutes in the dark. After removal of *Agrobacterium* suspension, inoculated cotyledons were co-cultivated in the dark at 24° C. for 48 hours, including media replacement by the fresh one after 24 hours.

Transformed cotyledons were transferred into the culture plates containing selection media (MS salts, Nitch vitamins, 3% sucrose, 0.6% plant agar, 1 mg/l zeatin, 70 mg/l kanamycin, 200 mg/l ticarcillin, pH 5.8) and incubated in the growth room with regime 16 hours light and 8 hours dark at 24° C. for 2 weeks. After cultivation cotyledons were transferred into different selection media (MS salts, Nitch vitamins, 3% sucrose, 0.65% plant agar, 1 mg/l zeatin riboside, 90 mg/l kanamycin, 200 mg/l ticarcillin, pH 5.8) and cultivated for additional 2 weeks at the same conditions till plantlet appearance on the cotyledons.

Plantlets with true leaves were transferred into high plates containing elongation media (MS salts and B5 vitamins, 3% sucrose, 0.08% casein hydrolizate, 2 mg/l glycine, 0.5 mg/l biotin, 0.5 mg/l folic acid, 0.65% plant agar, 0.2 mg/l zeatin, 90 mg/l kanamycin, 200 mg/l ticarcillin pH 5.8) and incubated at the same conditions for 2 weeks for shoot development.

Plantlets with developed real leaves were transferred into high containers containing rooting medium (MS salts and B5 vitamins, 3% sucrose, 0.08% casein hydrolizate, 2 mg/l glycine, 0.5 mg/l biotin, 0.5 mg/l folic acid, 0.65% plant agar, 1 mg/l IBA, 100 mg/l kanamycin, 150 mg/l ticarcillin pH 5.8) for 2 weeks for root development.

Developed transgenic plants were removed from culture plates and planted in growth mix in 25 L pots. The transgenic plants were allowed to grow in a greenhouse to maturity, T1 seeds were collected from the ripen fruits and stored.

Example 14: Production of Transgenic Soybean Plants Expressing Selected Genes According to Some Embodiments of the Invention Plant transformation—Cotyledonary nodes of *Glycine max* cultivar Jack were transformed using the *Agrobacterium tumefaciens* mediated transformation method described in Paz et al. 2006 (Improved cotyledonary node method using an alternative explant derived from mature seed for efficient *Agrobacterium*-mediated soybean transformation. Plant Cell Rep, vol. 25, 206-213).

Soybean seeds were surface sterilized for 16 hours using chlorine gas produced by mixing 3.5 ml of 12 N HCl and 100 ml sodium hypochlorite in a tightly sealed desiccator. Disinfected seeds were soaked in sterile water overnight in the dark. Seed coats were removed from the imbibed seeds and cotyledons were separated using a scalpel. Axial shoot/bud was removed and the junction between the cotyledon and hypocotyl was wounded by making five slices using a scalpel.

Cells of *Agrobacterium* carrying the binary vectors harboring the genes of some embodiments of the invention were cultured on medium containing Tryptone, Yeast Extract, NaCl, D-mannitol, $MgSO_4*7H_2O$, $K_2HPO_4$ and L-Glutamic acid supplemented with appropriate antibiotics for 24 hours at 28° C. Grown cells were collected by loop and diluted to the desired optical density of OD=0.6 at 660 nm into transformation B5 medium (as described in Paz, M M., et al., ibid). Wounded cotyledons were immersed in the bacterial suspension for 30 minutes at room temperature. After inoculation cotyledons were placed adaxial side down on co-cultivation medium (as described in Paz, M M., et al., ibid). Co-cultivation is performed at 24° C. for 5 days in the growth room with photoperiod of 18 hours. After co-cultivation explants were pushed deeper by the wounded side into solidified shoot-inducing medium with kanamycin selection and cultivated at 24° C. for 14 days. Explants were transferred to fresh shoot inducing medium after removing and discarding shoots from the apical area. Explants were cultivated at 24° C. for additional four weeks, including additional cleaning and transfer to the fresh media after two weeks. After shoot induction cotyledons were removed from the explants and explants were transferred to shoot elongation medium for two weeks at 24° C. Tissue was transferred to fresh shoot elongation medium every two weeks until elongated shoots were received (as described in Paz, M M., et al., ibid).

Received shoots were transferred to rooting medium containing IBA (Indole-3-butyric acid) 1 mg/L without selection and cultivated at 24° C. for 14 days or until roots developed.

Rooted and developed plants were removed from the rooting medium, washed with water and transplanted into the supplemented soil in 25 L pots. Plants were grown in the greenhouse for approximately 3-4 months until pod harvesting.

Example 15: Production of Transgenic Maize Plants Expressing Selected Genes According to Some Embodiments of the Invention Plant transformation—Immature embryos of *Zea mays* genotype Hi-II are transformed using *Agrobacterium tumefaciens* mediated transformation method described in Ishida Y., et al. 2007 (*Agrobacterium*-mediated transformation of maize. Nature Protocols, vol. 2, 1614-1621).

Maize plants are grown in the greenhouse in 25 L pots. Temperature is maintained between 20-25° C. during nighttime to 30-35° C. during daytime with high light intensity and a photoperiod of 12 hours. Crosses between male and female florets are performed and 12 to 15 days after pollination ears containing immature embryos are harvested. Kernels are detached from the cob by cutting the base of the kernel with a scalpel. Immature embryos are removed from the kernel and immersed into LS-infection medium (as described in Ishida et al. (2007), supra). After collection, are embryos centrifuged (2,700 rpm for 5 seconds, at room temperature) and washed 2 times with 2 ml of LS-infection medium and incubated in water bath for 3 minutes in 46° C. followed by incubation on ice for 1 minute. Centrifuged embryos (20,000 g for 10 minutes at 4° C.) are ready for inoculation by *Agrobacterium*.

Cells of *Agrobacterium* carrying the binary vectors harboring the genes of some embodiments of the invention are cultured on a medium containing Tryptone, Yeast Extract, NaCl, D-mannitol, MgSO4*7H2O, K2HPO4 and L-Glutamic acid supplemented with appropriate antibiotics for 24 hours at 28° C. Grown cells are collected by loop and diluted to the desired optical density of OD=1.0 at 660 nm into transformation medium LS-inf-AS (as described in Ishida et al. (2007), supra). Bacterial suspension (1 ml) is added to the centrifuged embryos, vortexed for 30 seconds and incubated for 5 minutes at room temperature. Embryos are transferred to fresh LS-AS solid medium with scutellum facing up and co-cultivated at 25° C. for 7 days in the growth room with a photoperiod of 18 hours (as described in Ishida et al. (2007), supra).

Selection is performed on LSD1.5A for 7 days at 28° C. (as described in Ishida et al. (2007), supra). After that, the explants are transferred to LSD1.5A medium with BASTA selection compound. Embryos are incubated at 28° C. for an additional 21 days. Only embryogenic calli that proliferated from scutellum are transferred to fresh LSD1.5A medium and incubated at 28° C. for 21 days.

Regeneration of calli is initiated by transferring to LSZ medium without any hormones and incubation in continuous light at 25° C. for 14 days (as described in Ishida et al. (2007), supra). Regenerated shoots are transferred to MS medium (Murashige and Skoog medium, Duchefa Cat: M0222) in magenta boxes and incubated at 25° C. for 14 days.

Rooted and developed plants are transferred from the magenta boxes to the supplemented soil in the 25 L pots and grown in the greenhouse for approximately 3-4 months in the same conditions as described above until seed harvesting.

Example 16: Plant Validation Assay

Tomato and *Arabidopsis* Validations

Transgenic *Arabidopsis thaliana* (ecotypes Columbia and Landsberg *erecta*) and Tomato (*Solanum lycopersicum* cultivar M82) were evaluated for insect resistance. Seeds were germinated on tissue culture medium (half-strength Murashige-Skoog (MS) salts including B5 vitamins; 2% sucrose; 0.5% plant agar; 50 mg/L kanamycin for *A. thaliana*; 100 mg/L kanamycin for Tomato. Transgenic *Arabidopsis* plants were identified by having dark green coloration and by continuing to further develop on the tissue culture medium. Transgenic Tomato plants were identified as those having green cotyledons and developing true leaves. Transgenic plants were transferred to standard potting mix soil, and they were moved to a quarantined greenhouse facility for hardening and growth. When reaching the desired developmental stage (described below), plants were assayed for insecticidal activity both ex vivo (detached tissue and fruits) and in vivo (whole plant assays), as described below.

Ex Vivo Bioassays

Detached *Arabidopsis* Leaf bioassay: Rosettes of early bolting *Arabidopsis* seedlings were picked and used for setting detached leaf bioassays with Lepidoptera species, such as Fall armyworm (including a Cry1F-resistant population), Corn earworm, Black cutworm, European corn borer and Cotton leafworm. 8-9 plants were sown per event to support 9 separate bioassay replicates. Each replicate was prepared as follows: 2-3 detached leaves were laid in inverted position on a 60-mm Petri dish containing 12 ml 0.65% plant agar, such that the upper part of the leaf faced the agar. An image of each prepared plate was digitally captured, and then they were infested with 3 $1^{st}$ instar neonates and incubated for 96 hours at 27° C. At the end of the incubation period, neonates' viability & weight data were collected and images of the leaves were digitally captured again. Leaf eaten area (cm$^2$) was computationally extracted by superimposing the images taken before and after the treatment. Neonates' viability and weight and the leaf eaten area data was analyzed by one-way ANOVA (Dunnett's test) in order to show statistically significant difference between transgenic events and the wildtype, which served as a negative control. Results are summarized in Table 34.

TABLE 34

Effect on lepidopteran species' eaten leaf area of transgenic *Arabidopsis* events expressing insecticidal polypeptides of the invention as compared to wildtype *Arabidopsis* plants

| Gene name | Event | Insect | % Leaf Eaten Area as compared to WT | P-Value |
| --- | --- | --- | --- | --- |
| ICM86 | 101775.3 | CLW | 41.32 | L |
| ICM86 | 101776.1 | CLW | 43.12 | L |
| ICM86 | 101778.3 | CLW | 51.45 | 0.002 |
| ICM86 | 101775.1 | CLW | 52.41 | 0.002 |
| ICM86 | 101777.3 | CLW | 54.38 | 0.004 |
| ICM494 + ICM495 | 101979.9 | CLW | 56.21 | 0.007 |
| ICM86 | 101775.1 | CEW | 49.32 | 0.007 |
| ICM86 | 101778.1 | CEW | 57.40 | 0.066 |

Table 34. Provided are relative percentages of eaten leaf areas of different transgenic *Arabidopsis* events, as compared to the eaten leaf area of the wild type *Arabidopsis* that is regarded as 100%. Gene names = recombinant polypeptides as per Table 26 hereinabove. CLW—Egyptian cotton leafworm, CEW—Corn earworm. Event ID indicates the transgenic source of the experimented seedlings. "L" - P < 0.001.

Tomato Fruit Bioassay

Reddish Tomato fruits were picked and used for setting fruit bioassays with Southern green stink bug. Two plants were sown per event to support four separate replicates, two replicates per plant. Each replicate was set and experimented as follows: a reddish tomato fruit placed in a plastic cup was infested with 5 $2^{nd}$ stage nymphs and incubated for 4-6 days at 27° C. By the end of the incubation period, insect viability and weight data, and also number of fruit piercings, were collected and analyzed by one-way ANOVA (Dunnett's test) in order to show statistically significant difference between transgenic events and the wildtype, serving as a negative control. Results are summarized in Table 35.

TABLE 35

Inhibition of Insects on Transgenic Tomato Fruit as Compared to Wildtype Tomato fruits

| Gene name | Event | % Survival as compared to WT | P-Value |
| --- | --- | --- | --- |
| ICM208 | 81_13 | 44 | 0.043 |
| ICM208 | 81_19 | 26.25 | L |
| PUB81 | 83_02 | 56 | 0.0167 |

Table 35. Provided are relative survival percentages of *Nezara viridula* nymphs on fruit of different transgenic tomato events, as compared to fruit of the wild type M82 var tomato that is regarded as 100%. Evenet ID indicates the transgenic source of the experimented seedlings. Gene names = recombinant polypeptides as per Table 26 hereinabove. "L" - P < 0.001.

In Vivo Bioassays

Whole Plant Validation Assay

Tomato and *Arabidopsis* plants are infested with 10 $2^{nd}$ stage larvae or nymphs per plant. Infested Tomato plants are maintained in insect cages in a greenhouse environment and infested *Arabidopsis* plants are maintained in a conviron under the same light cycles as utilized for seed germination and growth. Plants are evaluated one-week post-infestation and ratings are assigned visually based on chewing damage and defoliation of transgenic plants.

Example 17: Soybean and Maize Validations

Transgenic Soybean (*Glycine max* L., cultivar Jack) seeds were germinated on tissue culture medium (half-strength Murashige-Skoog (MS) salts including B5 vitamins; 2% sucrose; 0.5% plant agar; 4 mg/L Basta) and identified already at the juvenile phase via the expression of the selection marker bar gene using AgraStrip® LL strip test seedchek (Romer labs). Authenticated transgenic plants were transferred to standard potting mix soil for hardening and growth. During plant growth plants were sampled again and transgene presence was validated by PCR. When reaching the desired developmental stage, seedlings, or detached tissues (leaves, pods, roots etc.) were used for setting in vivo or ex vivo assays, respectively. The transgenic plants or the detached tissues were incubated with the target insects for 4-10 days, after which insect mortality and stunting as well as plant damaged tissues were evaluated as described hereinabove in Example 16. Data were collected and analyzed by one-way ANOVA (Dunnett's test) or Fisher's exact test in order to show statistically significant difference between transgenic events and the wildtype, serving as a negative control. Results are summarized in Table 36.

Transgenic Maize (*Zea mays* line B104) seeds are germinated and assayed by the same method.

TABLE 36

Inhibition of Insects on Transgenic Soybean Leaves as Compared to Wildtype Soybean Leaves

| Gene name | Event | Target Insect | % Survival as compared to WT | P-Value |
|---|---|---|---|---|
| ICM86 | 12_42_07 | CLW | 67% | 0.04 |
| ICM86 | 12_42_10 | CLW | 40% | L |

Table 36. Provided are survival percentages of 1$^{st}$ instar *Spodoptera littoralis* larvae on leaves of different transgenic Soybean events, as compared to leaves of the wild type Jack cultivar that is regarded as 100%. Evenet ID indicates the transgenic source of the experimented seedlings. Gene names = recombinant polypeptides as per Table 26 hereinabove. "L" - $P < 0.001$.

The foregoing description of the specific embodiments will so fully reveal the general nature of the invention that others can, by applying current knowledge, readily modify and/or adapt for various applications such specific embodiments without undue experimentation and without departing from the generic concept, and, therefore, such adaptations and modifications should and are intended to be comprehended within the meaning and range of equivalents of the disclosed embodiments. It is to be understood that the phraseology or terminology employed herein is for the purpose of description and not of limitation. The means, materials, and steps for carrying out various disclosed functions may take a variety of alternative forms without departing from the invention.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (1298 sequences)

SEQ ID NO: 1 - DNA, 1263 bp, Alcaligenes Sp.
atgaaattgcttgagttaaagagcgtatatagtgagcaggagcaggaaaggttttatacacgatctatttctttgggagattgggactactccgcgattattaaaagctcggtcatgtttggattgggacagatcccggttgtgggcaaagccttgtcgaccatcgtgggtttgttctggccaaaaaatgaaaaagacgtgtggcaaaagtccctggatgagctaagggagtacattgacaatcagattctggcaacaatacaaggaattctgaacggggagctgcgcgagattcaaaagaagatggagtatgtggcgaggttgctggaagagtctccgggctcaccggaagcgtgttcggagtataagaacctgcagttttatctggttggaaaagacgaaaagtttcgttcttttgatgaactgaccaactataagctgatgcccatgtatgcctccatgatcttgctgcaagccagctactggaaaatgggcatcgacaaaaaagatcaaattggcttgtcgagcattgacctgaatagtttgaaaaatcacatagatgatctcgcagactcatcccgaaactatattaatagaatatatgaaacggaactggatagaacgtacgaaaattccaggcctgacgaagtggccaataatatgtttgccgtccggggctatagtttgctgcatggcgtcgaggcggtggaggtcgtaaaaaatatccgtgatctggattttgataagcgattcaatatcaatgtgatcagctattccacggcggttgggacgattacggggggaatgatcgcccaggccttgactccggacagcgagatggcgcaacccttatgtccagaagtctttgggcagcaggccaatagaatcgtccagatcattggctatagcgggccaagaatcaatagcttgttcaggataggcggtttggaaataatctatgaaaatggtgacagcagcctgctcggtgaacgggtgggcaatcgcgatgttttcgacctgaatggatctctgattaagacggttgagatgagatatcagggcctgatggatgaggtcaagttcaccttgtttgatgggagggtgatgcaggtgggtcaaggcgaaagctactccggatatgtgaaatacgaagttgagggacactacatttcgggtgtgtttctaagtagggatcgcgctacctatccaggccgaacctcgacggcgtcagtgtcattcaatatggtgcccgctattagctaa

SEQ ID NO: 2 - DNA, 399 bp, Alcaligenes Sp.
atgaaagatcagttcagcaataacgaaattgaaaagttgtcgcgcggggtgggtctggaaacgagtccggcagacgagtctgtacaacttctgtcaggtggtacgtttacggttcccaagcacggttctgtgcaggctgcgaaatatagcacgccagttatccctgaaattcataagtcttactggatattcaatgccggaaaggcaaataaaataaaagctgttttttattggtctcattcttttacttccagctggtttgaatactcttctgtcgaggtcggaataggagaggaaaagaagctgcaggctccgtccaattctctgtactacagcaaagttgttttgttcaacggtactgatcagaatgcgactgtcagtgtcacggtggctaaataa

SEQ ID NO: 3 - DNA, 1083 bp, Meta Sp.
atggtcgagcttcttaaaccaattgtatatccagatgatgcaaataaccaagagaatgatatagaggtttcttttcaactttctcctgatactgattacatattgagcaattccaatttaaataaacagtttattccttttagcggagagtactggttacaaaattatagtccttatcccttttttactgatcgaaatcaactccaattcgtatacccagattattctaaaggagtaatggtgaagtatgttgatgaggaaggaaatgaaattcatgatccacaaactattagtggttcaaaaggagatgtttatgacgccagtacagatcagtacaaattggtcttagatggttacacattagacacatctaaactaccacaaaatagtataggaaattttaaagaagcgcttcaaacagtcacttatgtttattctaaaaatccagtggttgcagctgatgtgacagtaagatatgtagatatagagaataatcctatttcagaagatatcattttacaaggaaatattggtgaaaactattatactgataaaaaaaatattaaagattatactctaaaagaagttcaaggaaattcatcaggtcagttttcagaaaaggcacaaacagttacttatatatacaaaaaaaatgagttacctattgctacaggaaaagttgttgtaaaatatatagatacagatggaaaatcaattttaaaagatgttgttagaactggaactgttggggaagattatataactgaagaaaaaaatatttctggttatacttttcaaggaattcgaggtaattcaaaaggtaaatatacggataaaattcagaccataacttatgtttatactaaaaatcatattataaaaccaaaagatgaattagtaaattctggaacaaaaataataaataaaactaatccaaaagttaaaaactccagttctgaaaaatcccaaaaactacctgaaactggtgaaaacaaaaaaaggagtatattgtttttcattagtggactcactcttataactttagggtcaactattatagtatttcgacataaaaaagaataa

SEQ ID NO: 4 - DNA, 3729 bp, Meta Sp.
atgaaattttcaggtcgatataaagcaattcatatacatactcttatcgcccttctatttggcagcgccgcttttgggccagcacacgatgcgatggccgatgaacgagcgagtcgtccacggttctatacacccaaagcgagcggcgatcgggcaagtttcaggacctcggagttttatgcaaactgggggctcaatttacatcatttcgatgccgcctacgctgcgggggcaacaggtcagaacgtaaaggtggggcagctggataatccactgtatgtgaaacatcctgaattggcaggcatcaacttcagcgccgttggcagttatccactggccaccactccggcattcgatgcgggtacaggaaagcctgcctatcacggcatgcacgtggcgggcatcattgccgccagaaaagacggaaaaggcatgcacggcggcgctttcggtgcgaccgattttgtgacgggaaacttcagacaaacctctcaggcagtacaacaggctggaggaacgctttccaagcttggaaaaacgatcgttgacgccggggcagacttcatcaaccacagctatggatacaatttcggtatttacgcaattccgatggcgctcccggagggacaattcggatcacacggtccggacattcgtcatatgcagcggtatcgggatcgtcaacatatcgaattgagttctgccaacggcgtcgtgaacgtcagttcagcaggaaatgaccgatattatgctgcatacaaaacagcattcaataaatatgatgcacgaccccgcttgttccgagggatcggaaatggcgctggaatcaacagtattccttatatgaatcatcgtgagaagaatctgacagacgccgactggagtcgcatagaaaagggtatcttgagcgcggttatcctgaatgggactaaggatatcaacagttattcaaacatctgcggcatcagtaaatactggtgcgttggcgccgcaggcggcatgttgactgaaccggataaagcatatgccacaacgttacccgccctgccttaccctgtcgatttttatcatcccgatgccagcggccagaaatacagttatgaaaaactgaatggcaacatctcttcagacagatatcggatcctgagcctggccgtgaccagcaacgccccacctggctcaccagaagctgaggttatggatccgaaaaacctgcagccaatttaccgcatggcaatgggcacgtccatggcagcgccgaccttgacagcaggacttgcggtcaccaaatccaggtttccctatcttcagaactggcaaattcgtgacattgtgctgagtacggcgcaggatattggcgcgcccggcattgaccgcgtgtacggctggggcgccatggacctggaagccgccataggcggacctcgttctctgtttgcactgcgcagagactatatagagaagcttgcgcagtacgaagtagaggctgcagacaaatataatccgatcgttgccaaagccgattactacgctactcaggcctatgagctgaaaatacaaatgatcgaaaacgccaaacgtgccgcagaggcggaaaaagcaggcaatcaaaaagaagcagcgcaactgctcgcgctgaacaaacaacttgccccacaagaggcggcgtttcgcaagcaggcatatgagcatgaactgacacgcatacagccgaataatgaggcagacacaccccagaatgcctttgaatatatcaattttgtggttaacatcccaggcaaaaaatcagaggcctgcgcagaagacgcatgcgttgcggatgtctggaccaacgatatttcgggtcctggcggactggagaaaaaaggcgctggcctgctggcgcttgcgggcaacaatcattataccggcggcacaaaaatttcggacggcgtgctgcagttcggcattggtggcacaaccggcagcgtgaccggcaacatcctcaataacagctcactggtttttgcacgctccgatgaatggtcctacaaagatagcatcaccggttccggagaggtgttggtattgggcggtggtaccttccgcctgcagggggacaatacctacacgggtcccactcacgtctacgatggccgatttgccgtcgacggttcaaccatctcgaacacaattatttatggtggaggtacacttagcggcaacgggcgggttggtggcattcatgtccgtcaggacggtattgtatcgccaggcaattcgataggcacattgactgtcatgaaatcaggctctgccggcgcgggggcgggcaacgccgtttttgagccgggatcgcgactggcgattgagatcgatggccagggtaaccatgacgcattgaaggttgaaaacgcagccaatatccatggcggtatggtcgatgtcggtgtcgctaacctgtccagaacgcaactggcgcaacaggtcagacagagcatgcaaaaaccatatgagatcctgactgccggtgcaggtgtatctggcgcattcgatcaggcacgtctggatattgatctgccctttattgccgccggcttgcgctactcgccgcagactgtgggcctggtcctgggtagaagtcatcttggctttggctccgtaggccagacgtacaaccagagacagattggcgacggcattgagtcgctgtcaccgggccagcccttgtatgacgggttgctcacgtcggcttcacgccaggaagcagtcagcagtttgcagcaattgtccaatgtggatatccatgcttcactcaaacggacactgatcgacaacacccgattcatgcgggatgctgcgctcggtcggtccggattcgcttccatgccgaatatcggtgccagtgccgacgggaaactgcttggggaaaccaatatgaacgtttggggtaaggtgctgggttcctggcaaaaacacaaaggggacggcaatgccgcctcgctggatcgtaccatcggcggcctgatattcggcgtagatcatttaatgaaccggaactggcgtgccggggcactggtggggctgtccaatagttcactcaagagtgatcgcgcgtcagccaaaatcgacagttatcaatttggggcatatgccgccacagaacgcgaacgtctcggactgcgcgtgggtgcctcgctggctcaccatgaaatcgccactcgacgcggtggctatcccgacttgacgtccatgaacaaggccgattacagtgccaacagtctgcaagtctacggcgagctgggatacaaatttaccgcgaatgccgttatgatcgaaccgtttgtcaacagtgcatatgtgcatttgaggaccaacgcgttcgaggaagacggcgatgccagcaaggtatcgggcaaacgtcaatcagccaatgttgtatccagcattttgggcgcgagaatatcaaatatcgttgaaagtggctctggcaccgcattcagactgtccggcatgatcggctggaattataacgtcggagatattgcccccattgcctctgtgaattaccgtggcggaaacacctttgacgtccgaggtataccgctttcccgaaacgcttttgtgactgaggtgggaattcaggcaagccctaaaaagaacttatccgcaggcttgtattacgatggccgtttcggcaggaaagtatcggaccactccctgtccctgggtatcagctatgcattctga

SEQ ID NO: 5 - DNA, 4188 bp, Meta Sp.
atgtttgaagctgcacgcgtaggtgatgatatcggccactccggtgcgcttgccgggatgattgccggaacgattgtcggcggcctgattgccgccgccgggggcattctggcgggggcgatgtttattgccggacttggcgcatcctgcctgggcgtgggcgtcctgctcgtcggcgcgagcctggccgtggggtactacaccggggagctggcgaccgccgcccgcgacagcatcgcggacgccggggcatccagtatgacgaagaaaggcgtcatcacttccggctcgcccaatgtgtttatcaacggtaaacccgccgcgcttgccaccgatagcaccgtcgactgttctgacgacggctcgcagcagatggccgaaggctctaagcgagtcttcattaacagccagcctgcgtcccgcatcggggatcgtaccacctgcgacgcgaaggtgatgaccggttcggacaacgtcatcatcggcggcgacccgcagcaaaccctgcccattcagtctgaagtccccgagtggctgtataaagtctccgatcttaccctgctgttcgccggcctgctcggcgggtggggcggtgccgctggcaaagttggggcgctgtctaagctgctggggaaaattcccggtatcaataagctggcccgtatcgcctgccgcgccggcacgctgatgaccggcgttgccgccgcggggatcatcgcccgcccggtggatatcgtcagcggccagaagtttctcagcggggatgatgagctggacttcgtcctgccttcccgtctgccggtgcgctggcagcgctactggcgcagcggcaaccccggcgacagcgtgctgggccgcgggtggagcctgttctgggaaagccgcctggagccgtatcaggacgggctggtgtggcgtgcaccgtccggtgattacatcgccttcccgaatgtcccgaaagggatgcgcacctactgcgaaagcgaaaaaaactggcttgagcaccactctgacgacagctggtcggtgtatgacgtcagcggcgagcgctggcactacgcgccgcttaaggatgatgccccgtcgctgctccagcgcatctctgaaccctgcggcaacgctatcctcttcgagtggaatgcgaataatactctgcatgcccttaccgacagcgcgggccagcgcgtagtctgccgctacgacagtgacaggcttgccggtgcctggctggatgacgagatctgcctggtcagttacgcttatgatgaacagcgccagctggtctgtgtgaccggccggggcggtagcgtgcgccgacgcttccgctggcaggacgggctgatgagcgcccatgaggacgccaacggcctgctgagcgaataccgctggcaggagattgatggcctgccgcgcgtggtcggcttccgccacagcggcggtgaacagctgacgttcgaatacgattttgataacggcacccgccgtgcgacccgcgatgacggcgcgcaggcgcactggctggtggacgacgacgacaacgttgcgcgcttcacggattacgacggtcgtcagacgacgtttgtttaccgcgacggcgaactctgcgacgtcattctccccggcggcgcgatgcgccgcagcacgtgggacaaatacggccgcatgaccagcgagacggacccggcgggccgccgtacggagtatcactggtatcgcctgaccgaccgcatcacccggacagtgtatccggacggtacctcatcgcaggccatgtacgaccttcgcggtcgcctgctgtcggaaacggatccggccggtaacgccaccgcgtatgactatcccgacgatcaagaaaacctgccggagagcatcaccgacgccattggcggcgtggtgcgtctggtctggaaccaccaggggctactgacgcagcgcaccgattgctccggcagcgtgacccgctttacctacgaccgattcgggcagctgattgccagcgagaatgcggaagggaatattacgcgccgggaatggagccgtgccgggctgctgagcgccgtgatccacccggacggcagccgtgagtcgctggtgtggaacgaacgcggccagctcacgggctggcgcgacccgctggaaagcgaagtgagctgggcctataacgcgctcggcctcccggtcagccttaccgaccgaattggccgcgtgcgccagtggcgctatgacccgcgcggtaacctgctgcggctcgataacggcaacggggcggaataccgcttcacctacgacgccgtgggccgcccgctcagcgaaacgcgcccggacgataccgtgcgccatatggaatgggacgcgcgagggttcctctgcgcgcttgaagagaacggccggcctgccgccgacggcggcatcgcccgtcgcgtccagcagttcagctatgacgacagcgggctgctgatcgggcgcactcagcgccacgcggagtaccgctacttccgcgacctgagcggccagattacccgcatccgccgcacgccaaccgcagaaggcgttgccctgggtatcgaaagcgatgagattgtttaccggcatgacgccaacgggcgcgtgctgagcgaatccggtattaacggcgcggtgggctacgaatgggatgccctgagcaacctgaccggcctgacgctgcccggcgagcaaaagctggcctggctgcactacggctccggccacgtcagcgccatccgcttcgggcagcagctggtgaccgagttcacccgcgaccgcctgcaccgcgaggtgcgccgcacccagggcgcgcgcgagcagcttcgtcagtatgacagcctcggcagacgcacccttcagcgcagtgagctgagtacggacgtgaccctgccggagaaggcgctcctggaacggctgtatcgctacaccgcgcgcggcgagctttccggcgtcagcgacaccctgcgcggtgaggtggattacggctacgacgccgaaggtcgtctgctgaagcactacgaggcccgccaggggcacagccgcgcgcagttcagctatgacgccgcggataacctcgccgccagtgacgatgcggcaccggtcacggataaccgcctgcagcactggcaggcgctgttcatgaaatacgaccactggggcaacctggtcagccgccgcaacgggctgtatgaacagcattatgcgtatgacgccgagaaccggttggtatccgcccgcggaaccgggccggaagggcggtttgaggcgcgctatcactacgacgcgctgggccgccgcacgcgcaaaatcgtcactacgacgcacggcaccaccgaaacgcgcttcctgtggcagggctaccgcctgctgcaggagcagcaggagagcgggctgtgcaacacctatatcaacgacccgaatgaagcctggagcccgctggcgcgggtggatcatcttcgtgaccagaacagcggtgagatttactggttcaacaccgacctgaacggcgcgccgctggaagtgaccgacgagcgcggcgcggtgcgctggagcggccagtacggcagctttggcgaggtacgtcatcagagcgaagggttctcacggcttgtgaatcgcacggcgatggcgcatcagccgcttcgctatgccgggcagtatgctgacggtgaaacggggctgcattataacctgttccgctactacgacccgcaggtcgggcggtttattgtgcaggatccgattgggctgaatggcgggtggaacctttatcagtatgcgccgaatccgttggggtggatcgatccgctgggattgctgacctataacacgatgccgagtattactggtttccaaaagcatcatattattccacaacagttaaaaggccatgatttaataaaagcggctgattttaatatccatgatattaaaaatgttatttatttacctaagtcagctgattaccatccgacaagaacaatccatagtgggtctcaccctgtttatacaaaaaatataggtgaccagatggatgctatatatgaatatgggaaggaaaacggctggaaacaagcagagtataaacaagctgttagtgaaattataaaaaatgaacgtgccgatttacgcggtggaaaaactattcttaacaaaaactcggttagaaaagcgaggtgctaa

SEQ ID NO: 6 - DNA, 1668 bp, Meta Sp.
gtgcaccctattgcccgcagcttacttgcctgcggcgcgattacgctgctgacgattgcccctacccaggccgaccctgccagccagcaactacgagaccagcagcaagctcagcgtcaacgcgaacagctgcagcaactcgagcgtttgcaacgcctgcaaccgatcacttcgcatgatgacaggagcgctttcaccgacacctcagacaactgctggtcgattaccggtgtgcgcctgaccggtaatcaaaaacttccaacccaccagttgcagccaaccgtacaagcgttgtcgcagccttgcatgggcatcgccagcatcaaccagctgctcaagggcctgacccagcagtatgtagaggcaggctacccgaccagccggccataccttgctcgccctcctaagcatgagcaaccgctggatatagtcatcatcgaaggattcgtcgaatcgatcgagctgactgacggcgagctgccgctatcactccaaggcgcctttcccggcctgctgggcaaaccactgcatcttccggatatcgagcaagggttggaccagctcaatcgattgcgtgcctacgatctaggtatcgagctactcccaggcgaactgcagggtggaacccgggtagtgctgcaacctcgccaagtcacttcaccctggcacttggacacacgcctggacaatcgtggcagcgagctggtcggccgccaccgcctgaacctggggcttggcctggacagtccactgggaatgaacggcgacctgcgcttgtcgatggcttcgaccgtattcaatgcgcccggtcagagccgcgggctcaacctctactacagccttccctacgggccctggacttttaccctcaacgccagccggatgagctatcgcgcaccggtaccagaaagccacatcgtcagcaacggcaagagccgtttccttggccttggcgccgaacggctgctgtggcgtaaccagcgcggcatactcagcgccagcgcccgagtagatcgcaagcaactgatcacccgctccgatagcaccgtaattagcttgcagagcccgaccctggccacgctggaggcggggctcaatctgctctggatcgaccgtggcctgtggaatgcttacttgggcgtgagccagggaatggactggtttggcgccgatcgccccttgccacaagcgcagacgccgcgacctgatttcctcaagtaccgcgtcaacctgttgcatctgcgccagggacctgggcattggccttggcgctggcaaagcgagctgaccggacaatacagcgccgatgtcttgccagcggtcgagcaattccaactcagtgatgactctgccgtacgcgggttccgccagcacaccgcctccggtgccagcgctgcggtctggcgcaataccctcagtcaaccacttgaccttgcctggacccactcagtgcaggtgcgccccaccgtggggcttgacctgggctggacccgcttcgcgcgcgccagcgcttcgcaacgcttggccggtgctgcagcaggagtcgaactcagcctgccgcaaagccgcctgcgcctcgattaccagcgcgccctgtatgccagtgacaagcccgcaaaaggcctggagcgcggctactgggtgctggactggaccctgaccatctaa

SEQ ID NO: 7 - DNA, 3129 bp, Meta Sp.
atgaccattcccgaacgccgtctgctgccgaacgcagcggacaaaaccgccctcaaggccatcgccaccagcatcgtgcagacctgcccgagcctgctcgacgcggcccggcaagtcgcgatcgaactgctgacggacaaagggctatccggccttgatcccgacgaggtttatttccatcgtttcaaaacggcgcaaagcagcacgctgaccttcaccggttgggaacacttgctggaaaagccttatgaaacgctcaccctcacgcagttggtgatccatcgctttcgtgcaaccgatcaagacaacgcagatttgctgggcctttactgtggcttctactcggatggcccggacgcggagaatttcaatcaggacaacgaagtgcgactgcttggcagcgacgtgctgaaggcgttctgggccgtcgatttcagcacgcgctacaccggtcagttgaccaaattctggcaaacctcgtcggaagatttccgcgccctggccaagtgcaacttcctcagtcaggccgtgcaggcgctgcaagagggtgatgttgacggcaatgacttccaacgcatcgtcacctcgctgatcggcccgattacctggcccattaccctgcaaatgttgcgagccacatacccggtcggcgcgcaagtgcgcacgcttgatctggacggccatgtcgccaccaacgtcctgcgtctggtcgaagacagtggccggcagactctttacctgccgggagaacctcaggcctttcgactgatggacactgcagcggatctgcactggtggttgctcgatcagatgaattcagagcagaaacgccccttgtttctgaagcacttctcgctggctgacagcaatcacatcaccgagaacctcaccgatctgatgaaccgtttggtgagcacctggggccacagcgatcatcggatgatcaaccgcagcaacgttgcgatcagcggtgacgccttcacttggttaagcgagtcgacccgtgcgggcatggctgccgaggcgcatctggtgctcacatccaacagtgacctgcgcaagaaactctggaccgggtatctgagcgccggcctgaaggtgttcggcccgatggcggccgtgggctggccggtggctttgccgttgattggcgccggtatcgcgaacatggggctgaacatcgatcaggcgatcaacggcattacggcagccgagcgtagagccggggtcatcggtgcagtgctcagcgcgatcgaaaccgtattcaatgtgccgttcctgatcggtactggcgcgcagctggaagttggcccacaggtcgagtatgccggggctgaagagatgctcgggctgattgagctttcctcggctgacacgccatcattgccgcccgtggatccgccaccggtcaccgggacagaagcagctaccagcgagttgaccaacgagatccccgaagaagcgacatccgttaccgccactgagctcttgaccatgactgccacacggcacggtccgacttttccagaggttcctgccagctatcgatgcaacgagttgcttgcgcaacattcagtagaggcgacgccgggaaaatatgaaggcatttaccgtctcgacaaggagcccggttacgccatcgaaatggatggccaggcctactacgtacgttacttcgccgactctcaggacagtggcaactgggcaatcgtcaatcccgagcgccccaatcaattcgcctattcgttgccggttcgctttgggagcgccggcaaatgggagcgtatgcctgcgctgcggctgcggggtggtggccagtgtgtgggcaaggcgtgtgcgccggagactgaagtgagctcgtccgggggcacgccatcggtggaaatgcgatgcctcgaaccgcttccaggcgttccctgtccgctgcgcctggttacgaagctcaaaggcgtttcagagaaggaaaagccaggaatgagaagatgggcaatgaacctgcccagcgcatcggccgagtcagcaggcgctcggcgccgctttttatcaacgaccgagcggtacgtggaacatttcagcgaagaacgcagggctctgctgaacaaggcagaaaaattccaccgggagttgaaatggatcaatctgcccgagcgtccggacattccgcaaatcagtccccagatgcaggtcgatgacctgattgatcgcatctttgccaataccgatgggctggcggtcggtgaaacccttgatcgcatcgccagcatgcgcttcatgatcgaaaacatgccagcgttcgcgcggcatattcaaaccctttatgtgcgtgggctgctgagcgattttgcccagaatgatctcaaccagttcttcctgtcgggggacatgtcagaggacctgcgaacttatctgtccgggctgggtaccgatcccgagaacaggttcaacgttctcgaattggtcaagactgcccaagccaatggcatccgggtacacggactcgatgcagcgcacacctacacgctgaaacgaccgctcctttcgatcgaagaacagatgatcaagactcgcctctcaacaacaatcatagagggtgacaagcttctcaacagaacgaagaagtgggtagccttggtcgatgcaacgaatatcaatatgttcagagatctgccaggcataagcgaactcaggggcggcatcggtttgcgcattgaagaagtctggcccgaggagaccgcagacatcagcattgacccgggggtggaagtcgcccgcggtcctttttacaactgggcaatgaccagcaacgctttcgacgttctgttcgctgacctgcgattgcagatcaagagccccatgccgcaatggaatgcggcagcgctggaaaagcttctgcatcgtaacggcatgttcgtgattcagaagaccgaacccgacatatacacactggttcgccgcaacagcgacagcgacattgtgcgaacaagggtgcattgcacaaccgcgggccggttttatatctgggacctgtcaatgcctcgcatcaccggcaggaatttccacgacatcgccgcagtagcggagcgcctgatcgagctcggcttcaccctgcaaagtcgtttacccacctga

SEQ ID NO: 8 - DNA, 4653 bp, Meta Sp.
atgccaatcaagatagccaccaaaggcaacaccaccgtcgatgtccatttgcggccggatacgccagtggatccacccgcgctacgccctgacataaccctgcgacctggcttggaagccgaaacgctgactacaccaccacggccgggcagcaccacaggcagcgctgacgctgacgcaatcggtctggctccgaccgttaccgtgcaccccacccggtcaggacaggatagcgttgatctcggcgaccgatcgctggaacactatcgactctcccttacacccagcctgcccgcggccaataccgagggtttgagattgttcaagggccgccagtacgtagagctggccgatggcggcttagtgcaggttggcaaggaatcgcagagcggtctctggcgggccacgctggcgagcgaattgacgcccacagggccggcgatgctgcgaaaccccgacgacgggctgtggcatgcattcgagcactcgcagccaaccacgtttgccctgtcagcgacccgcctggaggactttcgcactgcactggacttcagcagcgccataggcgacagcgacggtctgcatcgctttgaaggaaagctctacgccgtgatcgacaatcacgcgtatcaggtactgcaagatctcgatgcctcgacgccctggtcgcaggtgatgcgcatcgtcagagccgaagatccggtggccgtcgatgcggacaatcactatgtcgcctcacgaccgggtcgctcgcaagcgattgtgctggacccaagcgagggctgggtcggtgtcagcaccgggggcgccggcgggatgcggcgggcagagcggaatccgtccgctcgtcgaagtctggcagagcgcttcttcgcgttcacccaccgttcgagccgacccgaggctcgggtacgaaaactctatccatcgttcgacgatcaacaggttgcagccttccttcgaacgctgggtgacgacgtcgacggcggactgaccacgaaggagaccgagtacagcaacctggaaaaagacctgcaggcgtggacagcgacacacaagcatctgaccgttccttcagcgcaagggcctgtcaccaattgggcaaataccgtcgctaacggaatcaaacgctgctggagtcaagaaacgacgcaattgcgctttcccctcagtcacgcaccgttacctgccctgagagcggatttcaaccatgtccgttttctggaaatggactcggtggcgtggtcgcctgctgcagaaacctttttgagcggctttagcggcctgcagagtttgaaaattacccgctcgggcctggaaaaactgccggcagccgtcagccaaatgcacaacctgaccgagctgaatctgcgcaccaacaagctccagcttgatgaggccagcgccgccgcactcggcggcctggcgaacctggaggtccttgtcctgacgaaaaaccctttgggcaagttgcccgatttcagcgcgatgcccaacttgcaagagctggacctttgcgccacaggcatcaagggctggccgaccggcctgaagggactgaccgctctgaaaaagatcgacttgcgccataacaagctgcaagaggtgcccgccgagcatctgaacccagcggacgaccagttcgaagccattgtccatatcaaccgtcacatcctgctggagaacaatgcgttccccgccgattactggcagaacttcgagcgcttctggctgcaggcggaggccaggaaagccgagtgggccgctggcgctctggaaggcgctttcaggctcaaggaaggcattggcgtcattgaccggacgcgaaatctgtatgcgcatctggacgtggccggcgcgaagaaattcatcatggggctgggcgacgatacagacgcggtgctgactcggcgcagcgaagcgtttgcccagttggacacgagccttgatgcctacaagcaatcctgtgcactgctgagcaacgccggccaacgcaaacgggcactcgagactgcgacggcgatcaggcaatgctggcttgaccagacgcaaacgacactgacgctcgattacctcggtctggtcgggataagcaacaaacaaaccatgctgccggacctgagcgcagacttcggacacgtgcgcaaactgacactgatcggggtggagtggtcgccggctgccaatactttcctgtccggctttagccatctgcagcacctgagcattggaaattcaacgctcgacaagccaccgacgatgctcagtcaaatgcaaacgctcacctggttgaatctgggttccaaccagattgaactggatgcgcaagccgtcgcgacaatcgctggcctgaaccgattgacccatctgaacctgtcgcacaatccattgaagataacgccggacgtcagcgccatgtcaggcttgaccacgctgaacctgagtcatgcgcagatctcccactggccgctcggactgctgaacaagaccgctttgactggcgtcgatttgggcagcaaccttttaaccgacgttcccgaggcccacctcaacccgcccgccgatcaactcgccgctgttgcacggatcaacaatgtcacgttattgataagcaatcccggcattccctccagctatgtgaggaaattcgaaggttactggcgtcgcctgaacacagcacatccggagttgatgaccccggtccacccttcagccttcgaccatgacaaatcgcgggcgcaacgctaccaccgcctctatccagccaaaagcatcaacgactgccgcaaatacctgtggggcctcgagcctggcaccgtgggcacgaggctgagtcagctcgaacgcgagttcgcggttttgaaccagcagcttgacgcatgggtattttccgggggaggtaaccgtcaaggttatattcctgccaaccaactcatgctcaatgccgaaaaccgagctgaccggaccacggcgcgagaccggatcatcaactgctggcggcaggaaacaccgcagcagacggcatttgacgggaccagtataggcctggagctggacctcagcggtctgaacctgccaagcctcccggatatcgacgcggacttcagccatgtgggttcggtcaagctccgcgatatgcacttgagtgcttcgcccgaaggcttccttacccgtttcaggcacgtgcgctggctggatctttccaaaaaccaattgcgcgtactgcccccggccattggccaaatgaacgggctgaccaaactgttcctgcagcacaatgaaatatccctgaccgtcgatacggcacggatcctgtcggaacgcaccaccctgcgagcgctatggctgagtaacaaccggcaacttggcatcgtcccggacttcagtcggatccccgacatgcgttcggtcaatctggctagcacaggcatttcggaatttcctgtcggcctcagcgcacagccctccctggacaccgtcaacctgagcaataaccgcattgagcaaattccggacttcgtctttgacgcggtgccgttccaggtcaacgacgtaaccaatatccgcttcaaccagttgaacaaccagtcccgcgcccgtctggtcgaatatgccgggcgcctcgcagccgccggcatgttcatgagtggcaggaataatctgatcgacacagggctgagcatgaacatgccgaacatcagggccctcctgctggataccatgacgcgctggaccgtcgggttgccagccaccgaagtcgccacaagacgacagcaatggcaaaccgtgcgcgatgagcaaggttccgatgggctgttcaacacgattgaccgcctgctgagcgagcccgccagccaccctgacctgcaacgcagggtctggaacctgatcgacagcatcacggaaaacactgctcaatccgaacatttgcgccgggaagtactggaccgtgcgggcgacccggcatgttgtgaccgggcggcgttcacgttcaccaatctggaagtgctgaccctcgcgcacaaggcccgctcccaggcccgtgacgaggcacaaggcaaacaactgtcggcattgtccaaggccctgttccgtctgcatgaggtcgacaagattgcctcagcggatatcgcccagcgtgaagcccgcatcgccgcgtccagaacacctgaggaggcacgattgttcgggcctcctcgcgtacccgaagaaatcgaagtgcggctgttctatcgctttcgcctgaaggatcgtctgcaactgccgggacagccggaacggatgggcttcgcccgattggcggacgtgtcggaggcacaactgaatgccgcgtatgaaaaggtgatcgcgcaggataattcgccggaagagtttcaggcactggtggccagagagttctggcaggagttcatcacgcacaagtaccggtcgcagtttgaaacacaacgcgatcccttccagacgcgccaggcgacgctagatgatgcgcattcggccagtgagctttcattcgtcgactacaaggcacaatcgatgtcgctgcaagccgagttggcaatcaaggaagcggagttgatcacaaccctgagccggcaggaactcagcgaatatgcgatgcaaaattccgaaacggcagcagttgaaactgaataa

SEQ ID NO: 9 - DNA, 498 bp, Meta Sp.
atgagtaactacgtgaagaagtttgccggttacggttttgctgccctcgttgcagtcaccgcaattgtaccggcgcaagccatgccgctgccggtggttccaagccagcccagcgttaacccggacgtggtcaacgtccaatattaccgtgattatgatcgtggcccgcgtcgtggttaccacaacggttaccgcggttaccgcgagccgcgcccaggttaccgccaccacgatggctactggttcccgcttgcggcatttgcagcgggcgcggtgattggtggcgcgattgctgcgccgaactacagaccggcccctgtctatcgtcccgcaccagtgtatcgcccagcgccagtgtatcgtccagcacctgttggtaacctcaacccacgtcactatgactggtgtgcgggccgttaccgctcgtatgacgcctacagcaatacgttccagccgaactacggcccacgccgacagtgcctgtcgccgtatttctga

SEQ ID NO: 10 - DNA, 1305 bp, Proteus Sp.
atgtcatctacacttaagcttaatgatggtttatctgatatcggttcgataatacattatggtatcagtcagatcccagtgattggaggtgtactaagcaccatttttggccttttatggccaacagataaggaagatatatggagtacgattaaacaggaagtgcaaagccttattaatgaagatattcaagaggacgactggaatcgccttgtggctgcagtaagcgagcttcaggataaagtatcatttatcaatgaccagttaattaatgcccagtatgatactgcgggccctgaactgatgacagtggttgtagatataattggaattgaagaaaacttcaaaatagaagggactaatttcaaatatgcatttgctccactttttgtcgccgctgtgaatttaaaaattgccttatatcttgaagggattaaatactctaatgatttaggattaagtcaagatcaagttaatcaattaaagtcattgcttcaaaaagatgttcaaagctccaagagttatttatctccgataaattcggcaataggcaatacttatcttaacaacatacagacctactttagtgttaagttatattatgaaacaagcgtgtctttatttaatgaactatggtcaggggattatgaagactataatgctcctgcaccgctggaaaattactacgttccagtcatggcagctggatctttctataagcttataagcctagacgggcaaaatttctcagtgcctatggcatttgctgaagtagctgataactcaatgatgccttctacaaacatcctgggatctttatatcaggagccaacatcttatccagatggctatattaattttatcgatgtttatacagacctgtcagtgtcacatcgaactactgggttaatgtttacctgtagtggatctgatgaacaatatgaaatgggtatgacgccaaataacaatgactcattcaatgttggacaaaacactatgagtattaatgttgagggtggtgagttcattaatcaggtgtctgtgagagcggactcttttgtttcacaaattgagttcaccactaatcttaataatacaatggtagcaggtcagcatcctgatgatgaccctatacaagaagtcactttagtcagcccattttcaattaactccatgtatgtggtctctgatgttgcaggatatatacaatcatctggccatcaaatgtgtgggatagcgatttcagcaatatataataatgaacttgcgatgcaatatgtcagcagtctatataaaaacagttaa

SEQ ID NO: 11 - DNA, 303 bp, Proteus Sp.
atgtcgactaattatgttattcaacctttggaaacagttacagtatgggacgatgctgagcctatcattccaacagttactaaaagtgtcattgtgactaataacggtgaaacgaaattagaagttgtgaattactgggcaccaccgtcacatgttttttatcccgataccacatattgggttgaacccaatgacacgattatcgttcaagcacccgaacgatcattttactactacagagttaatgtaactaactcggatgataccaaggtgggtgcggctatcgttgaaattgtagattag

SEQ ID NO: 12 - DNA, 4422 bp, Serratia Sp.
atggctgagatctgggcagcaagaaaggatgatgaactgatccacaccagcgcgttggcggacatcgccagcgccgtcgccgaagtcgcggtgtatgcggtggcgaccgccgccgtgtccgcagcagccgccgccgcagcgccggcattggcaggggtggcggtgctcggcgcagcggcgacggcggcctccggctgcgtcggcgccgggctgatcgtcggttttgccaccagcctgaccggcgtcggagaacatatcagcaacggctgcgacgccgtggccaactggctcttcccgccttccgtctccggcgtcattctcacgggctcccccaacgtcttcaccaacgccaaaccggcggcacgcgccgcaggtcgtttactcacgcccgcagagatcaaagcgttaccggcgccacagccgccgcaaagcttctgggattatggcgccgagctgctggccgccggcggtaatatcctctcgcagctatggcagcccggcgtcgccggccccagccagcccagccaaccgctggaagaagataaaatcagctgcgacaaacacccgcttccgcaatacctggcggaaggctccagtaaagtatttatcaacggccaaccggccgtacgcagcaatgaccgttcaacctgcgaggcgaaagtctcgaccgacgtctccaaaaatgtgcagatcggcggcggcacggtggtggtacgcgacatcaagagcggcaagctgccgggtatcggtttggcgctgaccgtgctgccgctgctgctcggtaatccggccaagctggttaagaacctgccttgcatgatcggcggcggtctggcggcggcgggcgttaacgccctcggcgaagcgatccacgccgcctttaacccggtgcatgccgccaccggcgccaaggtattgaacgacgaagaagatctggacctgttgctgccggcgcgctttccgctgatctggcagcgcaattacaacagccgcaatggctatcagggactgtttggccacggctggcgcacgccttttgaaatttgggtcgatcttaacgaccgggacggcgtcattgagtgttgcctgcatgatgaaaccggtcgtgagctacgcttcccgctgcctgaggtgaaccagccgagcttcagcgccggtgaagggctgatgttccgccgcggtgaagagggacagctgctgatcgccgacaccgacggcagcgtctggcggctgttcgtgccgctgccgcagaccccttcccgcctgaggctggtgtcgttgagcgatgagtacgataatgcgctgctgctgaactacgacgaacgacagcgcctgagccacatcgtcgacagcgccggcaccatgacattgcggctggaatacggcgatccgcgcttcgacgatcgcgtcaccgccttgcggcataacgacgaaccacgcgtgcgctaccgttatgacggcggcggcgatctgcatcaggtgatcgacgccggcggcttggtcacgcgtgaatttcactataacgcccaacatctattgacccgccaccaacaggccggtgggcccagcttcgcgtatcgctgggcgatgttcgacgactggcgcgtggtggaacaccgcgacagcgccggcggcggctgtacaatcgactacgatttggccgccgggttaacgacggtcaccgagtatgacggcttgcggcaccagcaccgctggaacgcccaacggctgatcgtcgaatataccgacgagcgtggtgaggtctggcattaccaatggaatgacgaagacatgctgatcgccacgcgcgatccgctcggccacggctggcatttccgctacgatgaagccggtaatctggtcgaggaagaggatccgctcggccatatccgcctcaccggttggctaccgcagcgcgcactgccgatcagcgtcaaggagcccaacggcgccacacagcatttctactacgacgagcgccatgccttgattgccgagatcgatgcgctcggccatacccagcgctacctgcgcgatggctatggccaggtggtgcaagccgtcgacgccaacggcggcatcagccatttcgcttatgatgagcacgggcaattattgcgcgcccgcgattgctccggcaaacaaaccctctacaaatatacggctcaaggctggctcagcgaggtgaccgacgccgccggcgaacgcgtccattaccgctacgatgccgccggccgcctgacacagctgcagcgcgccgagggctggcaagagacgctgagctggaacgcgcagggccagctggatcgctatcagggggccgatgggcgcctgacgcattatcgctatgacgcagccggccgcctgctggccacgcgcaatccgctcgatggcgaggtggtgcgccactacgacgcccgcggcagattaacggcgctgcgcaatgagaatgccgaaagctacctgttccattggacggcctgcaatctgttgcaggaagaaatcgggttggacggcgtcagcacccgctatcgttacgacgaatgccgccgggtcgtcgagcgccgcttcgccgccaatacctccgccgccttctcgcactatttcagccatgacggcgccggccaactggtgagcaaacagacgcccgatggagaaacccgctaccgctacagtccgctcggccaactgctgcatgccgccagctaccgcggcaacgcttggcatgacgagccgacaacggctcagagcgaggtcagttttgactatgacttgctggggcgggtgacccgtgagcaaggtgccaacggtacgctacgctatgattacgatccgatgggtaaccgcacgcaaaccaccttgcccgacggacgcacgctgcgcgcactgtactacggtagcggccacctgctgcagctggcgctggacgagatcaccctcagcgagttcgagcgcgacaatctgcaccgcgaactgagccgtacgcagggtcgcctgaccagccgagtgcattatgatcggctggggcgcaaagaccggcgggagatcttcaatgacaaccgccagcgcccggcgccggccagcagctcgcgccagtggtcttacgactatcaaaacaacctgacgcgcgaagaacacaacgccaacccgttctcctaccagcgttatcagtacgatgccaccggtcgattgctgagccgggacggcacgcggccggataccgagcgctaccggtacgatccggcatccaacctgctggatgaggggcaattccgccagcggcacaaccgcgtactgcattatcagggaattgattaccggtacgatgtctttggccgcacggtggaaaaacgcaaaggccactaccgttggcaatatctctacgacgccgatcatcgcctctgcgaggtggtgcgctacagccagcatcgcagcgaagcccagcagcatgtgcatttccactatgatccgctcgggcggcgcacgcaaaagcgggtgtggcagcaaagtcaggatctgcgccaaccggccggcaaatgccaaaccaccacgtttttgtgggaaggtttccggctgctgcaggaaactcgcgacggcatgcccctcacctatgtctatgccgatcagggcagctatgaacctttggcgcgcatcgacggccacgcgccggcccaagtattttacttccacacggcgccgaacggcgaaccggaaagcctgaccgacagcgacggaacgctgcgctggcagagccacagcagcgcctggggccgcataaagtatgaggaaaatcagcaagatctggattactcccaaaacctgcgcctgcaggggcaatacctggatcgggaaacgggattgcactacaatttgttccgctattacgatccggatatcggcagatttacccagcacgatccgataggtttggccggcgggatcaacctgtaccaatacgcgccgaatccgctgggttgggtggatccttggggatggaagccacgatgcgcagcaaccaaagccaacgatcataatcaggcagcttttggtcgacaatggcaaggtcgaggtatctacaaaggacgagactcttggtcaaatatcatgttgaaagaaggtgacattgtttatggcggcgctccagggcaatctggtttttacttcaacaaggcgacgctagatgctgcaggtggcagtagagccaagctatgggaaagtttgcaggtgcttccacatgaaaaatttggttatagatctaaaatacaagcatatagagtaaaaagagaaacgattgcaggaacaggtaaagcgatatctcaagacccaacgagattcggcgaaggcggaggaactcaatttttcctttctaactataaaactgttcttgagccaattgataagccttttgaaattggattgtaa

SEQ ID NO: 13 - DNA, 345 bp, Shewanella Sp.
atgagtgatttagaagtaaaaataggtgttaatcctgctgatgttcgttatacagctaattttaaagttgcaccaaacgacggatatgtgatgtatgaaaaaaatacgccaatcattccagaaattggtgtgaatattacggttataaatacaggtcgtgaagaaatggaagttcactatgaatgggctccaccatttggtggatggcaatgtgcatctacaacaataatcccacctgatggtaagcctgtttatattgctcatccgtcaaatgctttttattatcagcgaatcattgcttataacaaaaaagaatcaacagcgttcgggaattgcgaatactaa

SEQ ID NO: 14 - DNA, 1284 bp, Shewanella Sp.
atgaataatgaatatatcgtaacaatggaaaagaaaaacaacatagaattaaaaagtagtggtcgttatacattagatgatttttaccatgatcatgcttatgcatttaaagtcgctttgactattggacttaaaaaaataccttatgttggaagtattttatctacacttgttaaaatattatggcctactggagcatcaggtgaatctttacaaaacttatgggaaatggaaagaaatgaaattcaatcaatgattgatgaagctacacttcatactataaacgatatattaaacggaattgtaaattcactcggtgataaaatagccgatattaatagaactatagaaaattacgggtttgcagctgcaaaagatgattatataaacttaatttcaaattatataattggattggaagaacagtttaaatttgaaagtgaaggctctgaatttatagcttatgcaacaatgccactgttatctattactgttggtttgcaattatcatatttggcatttggtttagataataaagctaactttggacttgatagtgctgatatagataaatgtagtagaaacatagatgaaatttataaagatgttaaaaaatatatagaaaaatatgctaagtggtctgattctgactcttacagtaatgctaatagtgaaaacatatataatgaagttatgggatctcgtgctttttgtgctttaaatggatttgaacacattgaaatctggtctgaaatacaatcacgtaaatcacttgatttttcaattataagtacatctgtatcttattctgttgaggtcggtgttttaacgcctaacatgacaaggatggcaacagctgttgaagttggcccgcctttgttacctgttatggttgatggacatagaaacaagatagttaaaattgagggttgggatagtgtagaaattaatagttatcgtcgtgtcggttgccttaaaatcacttatgaaaatggtgatgtttacgatatgggtgttaaaacatctaatcctgttagcatttcacttgatggtgaatttgtagataccgtaaaagtcgttcaaggtgatacatatgcaattaattacatcaaattcacattaactgatggacgcacaatgtcagttggtgaacaaagcggtgatacacaactattaggttttgataatcatactattgctgcaatttttgttgatgaaggttcttcagataaaatttcatgtgttagcgtttcatgcattcctaagcagtacgaagaagaatag

SEQ ID NO: 15 - DNA, 1374 bp, Sodalis Sp.
atgaactctgaatcaaatacagcgctggatgttaccaacgtcgtttctcccatgatgacgcggggaaaatctaaagtgcctcttccccaatgggagtgggataatgcatgtgatattaaatactggatgatcaaattggcagggtttatccctgaagtaggggcgatactgtcgacgatgctggaggtctgttggccgtcaaagaaagagaatgtgtggcaacaaatattacatgaagtcgagaacatgattgaaacttcaaagctgaccattattcaaggcgtgctgcgcggctttattaatgagatggaggggaaagtcacacacgtgcagtttatgctggaaacccatccagggagtcgtgaggcgcatgatgcttacatgtcgttagcccggtatttgatcggcatggaagaacatttttgctcattcgatgataggaccaacctgcaaatcatgcctatgtataccgcgtctttgatgttacaggtcatgtattggtcaatcggcgtccacaaaagccaagaaatgggcctgaccgcgcgggaagtggaggagatgcaggacatcatagaccggctggttgatcgatcttcggcatattgtcatgctttatatgatacagagtatgacgaaatcattaatacctcagatgcttacgatatcactaatgatttattgtccgtgagaggtcactgtctgatgcacggtatcgaagttttagaaatcgtcgagcagataaaagcgcgcggtagcaaagaaaacatcatccttaagacattaagctattcggaggtttttgaccgcgtgacgcctaaaaccaaattacaggcgttaacggaggacgacaacatggttgcgcctctgaaaccggcgtggctgggcaataattatgcgcagatacggtctctcgtcggctatattgtcaggataggcggtgcgccaagggtaggcggcctcggcattacgtttaccgatggcaacacgtatcaattaggcactatcacgcgcgaatatcgtaatcttgagttaaacggcagtgttatcacgcttattgaaacctggggcagtggtgctatagatgaagccttatttaccttgagcgatgggcgcactttcagtttcggtcaaaggtatagctacaattatcggcggtttgaagcgcctggacattatatcaccggtctctacctggccagtgatgaaccctctcttcgtggacaagccgccggcataatggcgtcctaccatttgagaaatgacccagccaccccgtctacgcctgtctcatcggtcccaaggcccctaaaaagcctgccacgccgcgtggcggttagcgttagcgctcacggtgaggggcgcacgcgcgactaa

SEQ ID NO: 16 - DNA, 420 bp, Sodalis Sp.
atgactatttcaattaccgtatctgtatcccataatgacgtcgaattcgacggcggcaaactggataggcttcggcatggcgctgcaatcgccgctgacgatcacactgccagggtcacagaaggcgagatgcgcattgaacctcgttcatcactacaggctacgagaaccgatacgccgattattcccgagtcgcgcggccgtttttatgttgccaatgcgggaaaggctaaacaagtcacagccgttttttattggtctcatagttttacttcggaatggtttgaatatagctcaacggttatcgcacggggaacggacggcatcgtgatgccgccgtcaaactcgctttattacagtaaaatcgtgatttataacgataccgatgatgtggcctttgtcacggcatacacgctgtaa

SEQ ID NO: 17 - DNA, 1356 bp, Sodalis Sp.
atgacaaccaccattatcagcaccaaaaagaacggaccgggtttacgccacggacatgtttccactccagagtcccgtgcgtattttgcctggcaagaaggtcgactcaattccgggcaactcaatcaacgggaagccggtaagttcttccctgccaccgccagtggcctgaccgatagcgttgctccaacggattcgacaaatatgcttccgcctccggatggcaaaatcgctagcgccaatcaaggcgatggtgaattcctcgacgaaccgggcacacactggaaaaagcacagcgtggaatccgccgagctgttgaaagtgacctggtattactctgcgccgcacgctactcgccgctggaattatttcattacccgtgaaggttggaacccgaacatgccgctaagtcgtgcacagtttgaggataagcctttctataaggttgaactggaagagcagcctttctggagccatgccgctgcgttgaatccaccgaatccgaccgaacatttggtgatgttacctcagcgttccggctatcatgtgctattggccgtatgggaagtagccaataccggcaatgcgttctatcaggtgattgatctggactttatcggagacgtcagcccaaccacgcctgtcgcgcccggcggattacgtgcgtcagccagcaccaccagcagtattacgctgaaatggaacgccgcagcctctgcagccgaatatcgcctctatcgcaataacacgctgatctattctggcgaccaattgagttttaccgacaacggcttgccggaaaatacaacctatagttatgctgtcagctcggtcaacgaggccgaggttgaatctgctttcagtcagccaattactgcttccaccagtagcgatgtcaatccggacacgccgcctacagcaccgacccatctccacagtatgggcattacgacgaacagcgtcagcctgatgtggggcgcatcaagcagcagcgttaagctgaacgggtacttggtttaccgtgacggaaatgaaatagcccgtgtcaatgttgctcaactgagctacaccgataccggattgcgacccgcaaccgcttaccgctatttcgttgtggccgaggatattcagggccagctgtctgggacgagcaatgtgctttccgtctcaactgataaagatgaggatgatagcggcggcggcacgtatccacattggatcctgggtgagacctaccatgccggagacattgtcagccataacggtaaaaactgggtaagttatgtgacccacgtcgctcactcgcctgactgggcaccgggcctggcactttcgttgtggtacgagttgatctga

SEQ ID NO: 18 - DNA, 3030 bp, unknown
  environmental sample
atgaaaaagaaaacattaatcttaatagcattgtacctgtttgtacaattgacacaggcacaaaataatgataaaatacctcaggtagttttacctactcctcaggcacaattatatgaaaaatatgtaaaccatccgacggttgaatatacaggtacaccagaaataacaattcccttatacgagataactgtgaagggattgaaaatacccatctcgctttcttatcatgcgggtggcataaagtatggtcagttcgatggtgatataggggctggttggactcttagtaccggaggctacagagtttcaagaactgtttatggacaaccagatgagcaatatgatatgtatgacccaaatgagttggaagaaatgtggaaccgtccgtggacaggtgatataagaaagaaaatagaacgtgatacttatttcatggggctggaacgaaaactgcaccaggaggcgtatgtacgaacacaagacagccagcatgatttattcaactacatactgccaacaactaccggtcagtatattatttcggacaaaagaaataaaactgtagtaactgataaacagaatggtgataaaataatactggatgaaggtggttctttgtcgcttaatagtatgaaaataatcgatacaggtggttttacttatttacttggtggccaacaaaccaacccatcggctcttctcgtagaaacaactcttatccctggaacctctgcatcatttgctgataaagcaggatggccgctcaggcaaattcaatctccttatggtggaaatatcgattttacatacaaattgtatgaactaccatcagaaaatcgtttcggtggttcatttaccttaacagatgcctcatatttcatcgcgtcagctgcaacgggtccacaatactctacagccagtgggagtgtgagtttatcaaacggaagatataaacaatattatatagagaaaatcactacagataaagagacaataatcttcaagcgtttagggttttctgttccgggtgtctcacctgcaaatacacatgcattaagtgaaattgaaatcagagctaaggataatacactagtgaagaaaataatatttaatcataaaaaatctccggaaggtaataccacaattgatggtttctggcatatgctacttacgtctgtcagtattagtaatggtacaggtgagccacaaacatactcgtttgcctacaatgagcctactctatcaagccctgtttatgccgaccagtggggatattacaaaaacgcttatgaaggtcgtccgggaggtagaataatctggaacaagttattcttacataaagaattcgcggatgaagtattaatgccctggactaaccctaaccatagttacgaacccaccccactaaaatatgtgtggaatggtacttatccgggaacagcttcttataactttgtagatcgttcgaataatagtagtgctggcctacactttttttcattatcccgcataacttaccctacaaaaggaagcatcgaatatgcatatcagccaaacaagtatgaggcagggggagaaacaattagtggtagtggacaacgtgtatggaaaattatatctaatacggaggatggaaagccatccatagttactgaatatacatacggcaaaaatggagatggattgggtagtgtctcttcatcagcttatctttccgaccgtttctttgctacgacaacaattctttctgaaataattagttcagatgtaacattagtttcttctaataaattcagccaggtacgcacatattcgtcaagcccgtatcaggcagatttactggatttaatgactgtagtttatcctgaagtcacaacatctcaatatgatacaagttcgcgttcctataatggaaaaattgtatctacatatcatatacctttcaagataggttgttcttccataggaggtacaagtattcaacttggcaattatccacccccaaccaaatattggaatgattattatattaatatctataattttggaaaccaaccgtatttaaagtccagagtaacttataataacagtaatttacctctcattcgggagtcgttcgagtatgagaacctgaaatcacaaatatttaagggcatccgtgctatacaaaaacaatcatgtgtagaccgtccggtttttctttactatgaactatatgagagtccttatacttatattgacccgatgtgcattgcagacaggatagaaacaacacttaacttcaatcgcataaaatcaaaagaggttgtttcttttgagggtagcgactccataaaggttactgaaacttaccaatatgatgctctgaaccgtgtaactcgctctgttactacaaacggtatagggtcgacccggcaaattgaatatacttatccttcttcagggcagcttgtgaccaaaaataaaataggtgagcctgtaagaacgaagactataaacaacaatattcctactggtattgtggagaaaacatatccgctgaatgccataaatccttcttctttgcgatcgtcaacaggtaatgaaagtacgctacgaacggatattacttacaatcaatatgacagtaaggggaatttattacagtatacccgtgccgacggaactatcgtttcgtatttatggagttataattaccaatatcctgtagccgagattgttaatgccagttatactactgttaccaataatctttcgggagtaacagctgcttcactggctggtaatgctaatcctgatgacactgttttatcagcggtaaaggctttgagaacattgcttacaaatgcagaagttactgtgtataagtatcgcccgctggtaggcataatcgagcatacagatcctcaaggtatctctacctggtatgattatgacgatttgggacggctacgggagacttgtttcaaagagtttggaattaagcgtatactggaatcttacgactacaattaccgtaaccaataa

SEQ ID NO: 19 - DNA, 480 bp, unknown
  environmental sample
atgcaggaagacacgtaccgtggcgatggtctaaatctttatgcctactgtgcgaacaatccagtgacctacttcgacccaagcggcaacaatggcctgctgaattgcccgcagccagggtttgctccgggaaatggcgatccagaaactttatatcactatactaatgaaaaaggaaaagacgccatccttgaatcacaagaattatttccatcattaaaagcgaataatcctaaagatgccagatatgggaatgggcagtatttgtcagatattaatccaactactacaaagccagcatcacttgccagcaaatttataagaactcctaacaaatataagtacactcattttgttgaaatagatgtatctgatctcaatgtagtaagggggcgggatggtgtatttgttattccaaataataactctttggatattagcggcagaattgttagttctggaaaagtcggaagtcagtag

SEQ ID NO: 20 - DNA, 2169 bp, unknown
  environmental sample
gtgaaaaggaagcttacatctttagttgtgctgtttttatttactaatgtttcttacatatctgcatgggccgaagaaacctctactgttgacacctcttctaccgagcagaccagtcagcctgcaactagtgaagtcgaagattcgactcaagtatcttcgacggatcaggtaactacgccttctattcacgtctcagaacccgcagctagtgaagaacccacggaacccagcaacgaaccagaacaggaagtcacctcagaagcaccgaaaataagtgcactggcagctgttggagacggtactgaagctaatccttatcgagtgacaacctttcaagagttgaaggatgctctgggaaccttggtagccgctggacaaacccagtatattcagctgcaaaacgatattgtttataacgctactggtatctctatcacacaaaatacggtgatcgacggaaatggtaatgctcttttgtatagtggcacaacttatgatcctgctcaatttcgtacaggcgcaaacaacattagtatcacgtataaaaatttgtcattcggcaacagtacgtatcctaacagtacctggtatggaatcttatatactggcaacagcggcgttaattttacggttgaaaacatcaactacactattaaaaatgggaatcagccgttttgggggaacaatggcagtggtaataagttgaccttcaaaggaaaaaataatttttactcttctggcagctcttatggaggagaatttgtcgaagggtatcctacggtagtttttgctgaagatagtgagacaacagtttacaatgattcaccaaatgcaacgggtgttttctatagtactggtcaatcagttactgtagaaaaacgtgcttccgtatctattgaatctagtaaagactaccttttttacaatagtgcgacattgaatgttcaggagcagggtaaattttcgtacaaaactattagagggactaactattcttcaaatacagccacattatgcgttggaactttgactgctaattttgccaacgattccattggacattttaccacggatgttaatagctttactgggagcaacccgattgtcaatctgaattcgccagattatgttgtttttgatgcgacaagctcgtctaaaaaagttatcgatacaatgaatccaatcttcaaacggactgattcagacacttcgttgtacaagattgcttatctgacagccagcggacaaaacacttatgtgcctaaagtgaactctggctccagctacaccgtgacctctagtaatatagggaacggctattctgttgcctatgctaaaatgccgtcgattgaagctcccgccgttacagcagcaacggggccagacattagcaatatcgctgcacaaataaacaatgctgcacctgcaactacactaagcagcaaagtacaatataagctggccaataagcagctttacagtggggatcttgctgctgatgctgcccaaagcagtatcgagcaagctgaaacagcagatgatgggattatcgaaaagaaggagctggctcttcctggagatggattaccaattggagatgacacaaagcatacctttgttcatttaccacctggaaattatcacgtatatgctaaaaccaacgatcagcgtgttgctggttatacctttgaaagcctttggaaagaatcaactgctgaagtgcagccctttatacaggtacagttttccagtaatgccatgagctttaacagccccatacctggtcaattcggcaaacagcaaaatctagacaattatacgatacgcaatgctggaaatgtccccaccaatattaacttaaccagcattacccgcaactcagacagctctgaaaaactttctttagttgagcaatttgatactaataatcaagagctgctcttatctctcattgcagaaaaagctggtagcggtactcgaaccaccttcggccctttggtggacaaggacccactaagtttagataccctgcagcttgatcctttttgggaggcggatgcacaggctgacctgtatctagctggagattactcaggtccaatgatcggaccgcaaaatttcagctaccgtttttcatttgctatttcagcagtcactactaattag

SEQ ID NO: 21 - DNA, 669 bp, unknown
  environmental sample
atgtttagactatatgaggaatttaaaacaatagaggaaggtaaaacttggggagaaaaatattatatggcatggtgtaaacgaataattgatgatcctaaagttcttacttgtaatcaccaagataaagcaaatcctgataatgactactcgttcacggaaactaaattaagtatatttcatgcttacatgggaaattcagcaaaacaatttattaaccctagcttaagaaatcaatgtataacagaattcgaaaatttttatataagtaacttagctgaatctttagatctcgctccgaaactagatagaaatatagttgtttatagatttgttaacagagacatagctgaacaaattgaaaaaagttcgcgtttcaacaaatttactgagaagggatttttaagtacttcattaactaaaaatagatctagaaagtacgataccgacttagttctccttaaaatttatttaaaaaaaggaagcataggagcttatattgaaccattagataatagaggattagaacaagagtttttaattcagaaaggttcaaaactatggaaaaagaaaaaaataaaacaacaacaacttattgctactagtcttttaaatagcccttcattcaaaattgatttattggagtgttactgtatcactaacaaatag

SEQ ID NO: 22 - DNA, 1218 bp, unknown
  environmental sample
atgactcagatttctgctcttcaccttgccgcagaaagtacccagccaccgttacatatgctgacgttacaggcattaaatatgatcccgcctgcctctttttctgcttccgcgatgtcaccgcagggaattgccactacgatcctcagtatggtgctgaagctggtatataaaaaaatgacagaaccaaaagaagtggatgttatcggtattattcaggaaacactgatgaaaaacacctcggaatggctggaatcggaataccaggctgtccgcaaagatgccgaaagtttacaggatgcaatcagttcctggcaaaattcgccgacagaagaagcgcggcagctgattgtggtgcgcaatgaaattgctgtcgcggatatgcgccgtctgtgcattctcagtattaataccgcaaaaagcagaggaattgtccggctgtgcggtgtatgtgccctgtcctgcctgctctattttttcacactgcgcgatactctggtattcggcaaaagctggggatacgcctctgatgttctggaaaaatacagtaaggctctgacagaacaggcagatattatgtttaaggatgtactgacagcagagatcaataattacaccgaaaatgatgatttttatgatccggaaagtcaggccaaacgctccgtcatttactggacatccggttataccaatattcaggagcacctgacttacggtgcacagcaaaaacccacccgtgtctgccctgaacgtagtgatatcagcgctaatccggttgatggtgaaaatcatacggtttatctcggcaatctgtttctgacggacagtaattcttccgctgacggcagctataactacttgtctgccgccgaaccccgcagctatgacagaagcggtgacccggtcaggttaccggtcagaagtgccggtttgtatcatatccggctgtattatgcctatatgaccaactccctcagttttgattatgaaacacaactgaagattgaacaggccggaaaaatcatcactgatgcccatctgaccgatttaaccaaaacggtactgacaccgtataaatccggctcaaattacggcccggtgatttaccgcgaaacacaactgcacctggaagaaggtgatattgtgctgacattccatgaggatcgttcactctccggcggcggattattgcagcatgttgagtttgtgaaagtgtaa

SEQ ID NO: 23 - DNA, 2793 bp, unknown
  environmental sample
atgataacgcctcaaatttcaaatattcatgcgggcacaccaacaataacggcattcgataaccgtcactttacggttcgtacacttcaatactatcgacagcctaatattcaacaggatgtacaggagcgtcttgaatttcattattttaatatttatggttttttacagaaaaatgcagatgcacgtttgtctgaaagtgggcaagataacttttattatcatgcggatttaatggggttctcgttattaaacaaaggtgttgatagcggtgaaatttaccaactgaatgatattgaacagcggcttatggtaagcattgacgcaaataaaacgtttaaatggtgttgctatgaggctaatgattcattaggtcgcctcgaaagtgtcagtgagaaaatagagggagggaactggcgagtcagcgagcgttttcaatatgcaggtaattcgcataccgaacaattggcgaatttagctgggcaatgtattagtcactttgatactgcagggttattgcaaacacaggaagtatcactgcaaggggaaccgactttattgactcggcagtttattcaacaagttgataatgctgagtttaatgttgattggcaagaagatagtgatttaacggcattatcacccgaaaaattttctcaccaaacacattttgatgctgcaggtgcttgcctttctattattgatgcaaaaggccataaacaacagcgagaatatgatattacaggtcagttaatcagaacgacattcacagttaaaggacaagatacgcagccaataactcagatcattgaatattcggcagtcggtcagaaagtgcgagagatctatggtaatggtgccgtgactgagtatgtatacgaggcgcagacacagcgcttaattcttattcagacctataggccagtaaatcactcattgggttataaattatttcagagtttacattacgactacgatcctgtcggcaatgtgattgcaatttataatagtgcagaaaaaaaggttttttggcggaatcaaaaagtcgaacccaagcatcgatatcaatatgacacgctttatcaattagtccatgcgacagggcgagaaatagcgggtattagccagcaaagtcactaccttcctcaccattcatcaattgataattcggtatatacacggtatttccgtgcctattcttatgataaaggcgggaatttaattcaaattcaccaccgtgcccctgcgatgcagcaagcttatacaatcaaaatgacaacgagcagccgaagtaaccatgcagtactggcagatttagctgagtttcctcatcaagtggaaccattattcacgccaagtggacagcaaaaacagcttttgcaaggaaaaaatttaacgtggacatcaaggcaagaactgcaaagtgttaatggtgctggcgggaatgagttttaccgctacgatggcgacagccagcgggcattaaaaataacacaatataatcaaaaacaaagcaaggttgtttatttaccgaacctagagattaggcaaattgaacataatgaaaaataccatgtgatctgtatcggggaagacagtgaggtacaagcccaagtattgcattgggaaattgggctaccagataaaatggtaaataataccgttcgttatagtattaatgggcttaccagcaatagcggtttagaactcgatatggatggaaacttgattagccaagaggagttttatccctttggtggaacggctgtttggacggtaagtagcgcattggaagtaaactacaaaacacggcgctattcagggcaagagcgtgatattacagggctttattattatggtcgtcgttattatcagccttgggtggggcgttggttaagcgcagatcccgcgggaactattgatggtttaaatctgtatcggatggtacgtaacaacccattgacctatcaggatgaacatgggttagcacctcgactttttgatacacaagatgatatgtttgctgatttccagcaaacagtatcaaagctgcttaatgcatcctctaaaattgaaagaattgcgaaaaatccatcattaattcgcaaccgagtcattagtatggcgcaattattttacaaagataaaacatccaaatttacatatgctattaatttatatgaatttttggagatggactcgcaaagtgaggagtttaagacatgggcgacaaataaattaagctatcaaaatacttctcgccagcgtcagcctggctgggaaacggttaatcatgcggagcaggcattaataagaacattaacggctcatgatagttttaacataagtaatttaatcatatcccaaaaggctaaattatgttcaagttgtgaaaatgccatgtatacttttcgacaatcaatgcctaaacgtcgcttcacaacgatgattcttcgagatggtgatttacctcttgcagccatacaacatgggcagtcacgaactcgctataaaaactcttcatattctgctggagtggcggtagggaaaacgagtttcacattatacgactataaagatatagagtttcaggttggaatggggaatttctggggagggatggataaaacactctatacaatgtatgccaatgagtttgaacgtgtgtttgggaatcttcctatcggaaagggagtcaaaaagtcatttccccctaaaccccccaaaagctcaggaggtcgtggccatcagcttgataaaaatcaacccagtaccagtcgtcgtcatcgatga

SEQ ID NO: 24 - DNA, 1560 bp, unknown
  environmental sample
atgaatattaaaattttcaaattcattgatatttataccaatgggatttttgttgaattcaataataaagaaaataaattattatcaattaatttgcttttaaatgatgaaatcatagaaaaaaccgaaaccacaggtgaaagtcatttattttctatcgataaatcaggtcactatcgtgtagagattagcctggaggctgaaaacacagcaaacatccaatcaaaggaaatttattttcatatcagcgaaggtgaaagaaaaaacaaaattaaaaccaccactaaagaaaaaacaatcaatcaaaaaatagctggtatttctaattattatttagatataaaagcaaaaaagaaaaattatgataaaataaaacaagatttaactttttactcaaagctcccgactttagaattaaaaaggtcattaatttatgacacattaaatgaatatgattattttacgttccatggagacggtaaatttgaaatcttagttgagctagcggaacaaatagagagtttagattatgtcgagtattgttccgtcactccagataccacagggtatctggccccagaactgcccgtaaaccctgagcaacttgacgatattaaaagcgaaagtgacgattttattacccctgattttacaccaagacaaacttaccttgatgcgcccaaagggatgaacatccgcgatgcatgggcaaaaaatattaatggttcatccgcagtcgtacgtcacttagactttggtgtctaccgaaaccatgaggatttaatcgactcaaatatcgttgtggtgaatagccgcccagaaagtgaagactgtaatcatggcactgcatcaacaggctgtatcgtagcaacgctcaataaatttggtgttacaggtattgcccatcactgccaattttacttctatgacacaggtgacctagatttaatcgtcaatcatgtgcagcctggtgatattgtcagcctagatatacagtttagtgttggaggaaaactgctccctgccactgcaatacgtagctggtgggaacgtatgaaaattatcgtggataaaggtgcaacagttatccttgcggcgggcaatggcggattggatttaagtgaacctggcgtgatgcaggatttcggtgatagtggcagtattttagtgggtgcttgtaaccaccaaaacggaacacgagcttatttctcgaactataacccagaagttgcctttgtgaattcttggggagactggagtgtcaccacaacaggttatggctcattacaaaaattaccagggaacaaccgcaattattcaaataattattcgggtacatccagcgctacaccattatgctcaggtgcattagcgttaattcaagattacgcgaaaaaacaaggggcaatattatctccgtggcaaatgcgtaccgttattgctgcatcaaattatactgaaggtgtatcacacggcattggttgtcgacccaatgtagattacttgtttggtatcgttgatagcatcatccgcaagtcagacttacccgaaagcgcgtag

SEQ ID NO: 25 - DNA, 2163 bp, unknown
  environmental sample
atgaattccccttcgtcaaaattgaactcaaaactaccgagcagtttaatactctctacggtaatttggttcacggctattgggctaatagtgccaagttatgcccaaatcacctatttagacgatttacctacgctaggtagcaatgcctttcaatttgagggaacccaatcaggagatagcactgaacgttttttagcagaatatgggcaaaatgcagcaaactttgtatctgaagaaaaaaaacaaaaaaaacttgcagatatggcacaagattacgctcgccataaagccgcaaatatcgctactgatgaaataacacagtggttatctaaagcaggtaatactaggctaaatattaaccttaatgaaaagttatcaattaaaacctctcaattagattggctagtaccttggtatgaccaacatgactttttactattttctcagcacagtattcatcgtactgatggtcgtctgcaaagtaataatggtattggattacgtcattttcatcaaaatagcatggtcgggataaatgctttctttgaccatgatttatcccattaccattcgcgcttaggacttggtttggagtatgctcaagattacgctagggtgagtacgaatagctatttagggctatcgacttggcgtagtgcatccgaattagcctataattattatgtacgcccagccaacggctgggatattcaacttgaaggttggctacccgcttattctaatttaggtgctaacctaaaacttgaacaatattacggtgatgacgtggctttatttggtacaaatgaacgccagaaaaacccaatggctgctaccgtcggtgtcaactggtctccattccccctccttgctctaaatgtagaacatagaataggtaataatggagcaaatgaaacaggtgcaaaaattgcgttcaactggttgttagggagaagcttagagcagcaccttgatacttcagtaatagaggctaatcgtcatattcccaacaatcgctatgactttgttaatcgtaataacaatattgtgttggagtaccagaagaaaaccttaatttcgttatcattaccgaaagttattcagggcgtgacaggagaagaacgctctattatccgcaacttaactactaaatatcctatagaaaaaatagttgtagatgcccctgaattgatagctgctgggggaagactccaccttaatggaatagatagttcagtaaaattgccgtcttacaaaattaccaacaacgcattaaaaaaccaacagctcaacctctatcgcttaaccgtgacggtttatgacacgaaaggcaatgtttcaccacaagtggaaacgttaattgaagtaactggcacaggcgcgctcactatcactcatgaaaataccaagaaaagaaataatggtatcgctgatggtaaggacgcaaatacattcgccatcgtaattaaagatcctcttggtcaccctgtccccaatgcgaaagtcaacttcgtattgcctgcaaatcttagatctattgaccaaaaaaatacgggatattattcattacttaatcattttatgtggaaagccaaagctaaaaaagcggtttctgagcaaaaatataacattatcgccaatgataaaggcgaggcatccatacaatttactacttttatatcaggaagttatgtagtaaaagcaaacactgagtatggcccagaaattaatgaaatgtatcactttaaacccgatattagtcagtcatttattagtagtattgatatcattcgaaacaatgtagcggcagatgggatcagtaaaaacaaaatcaaactgcgtattataaataatagccgacaaagcattgctggtgcacttgttcactttgaagcctcaaatggcattatctcaccagctaacctgactgatgagtatggaaatacggaattagagatcagcagcttagttgaaggttccatagatatcattgctaccttgaatggcgatagtagaacaatacaagtgaattttctaaagtatgcacctacctcatatattcaaccaagcacagagagtcttttcaagccctcaataaatgagcaaaacagacatacatcgttaagtttattaagggaactatttcaaaaaattggataa

SEQ ID NO: 26 - DNA, 2199 bp, unknown
  environmental sample
atgagctccgtaaaaaataacctcacacaccgctttgagcctccctcatacgctgaacggcccagctatgccggggccgcttcggacaagccgtcctacactactgagcaagcggcagagcaaatcacccgaacgggctatcgttggaaagagcgaaacccggacggcaccacacccatctcctatcgatttttcacaccctcgcaagccacctacaacacacccgccggcgccaacgagttttctaagcatcaaaaagaacaggccaggcgcgccctgcagtcttgggcggatgtcgccaatatctctttcactgagaatgcgcccgatgccaacgggcacctgatactgggcaacgacccacagactggcctggcagggtatgcgtcttatccgggcgtttacaacaacggcacacaggcctggttcgcctcgggcggcagcaattatttcttcactcacggtagtgtcagccgttatgtgctagcccatgagatcggccataccctggggctcatgcatcccggtaaatacaacaatggcggcagctacgctgaaaacgcccgctatgccgaggacactcgcgcctacagcctgatgagttactggtgggctggccacctgggccacgaccataacaagaacggccaaacccactacgccagcgcaccactgatggacgacatcaccgccatccagaagttgtacggtgccaattacaaaacccgcaacaccgacacggtctacggcttcaactccaataccgggcgtgactttctcagcctcgactcaccagacgatgcgcccgtgttcaacgtatgggacgggggcggcaacgacaccctggatttttcacggtttcatcaggcccagaccatcaacctgaaggctgaacacttctctgatgtcggcggcttgaaaggcaacgtctccattgccaaaggggtgacactggaaaatgccatcggcggcacgggcgctgatcgactcatcggcaaccatgccgataatcgcctgactggcggcctgggccaggacatccttaccggtgggccgggcaaggatacgtttgtgtataacaacgccagcgagtcgaccgaacaacgcccggaccggatcaccgacttcaccagcggcgaggacaggatcgacgtgtccgccgcgctgcgggcagccggtctcaaggacttgcactttgtccgccgtttcagcggccgcccaggtgaggcgttgcttggctatgatccgcgctcaggccaccacagcctggccattgacctgaacggcgccggtcaggccgatctgtttatcaaaagccaggggcccataaagccgggcgatgtgatcagccaggcatcacacgcaagcacagcgccaacccggcccttccaggttacgccgcaaccgccgacgccagcgaagacagcaccgtacgagccccgccgcgagacaatggccttaccgcaacaagcgccgttctccttgcagaaccacgccaacgcaaccctaaaaggcacaccgatgcatacagccgccagggccgtgggcagtattcgcgaagtgagcgtttcacgcgactcgtggggctacgaacgcgtacatacgcgttcgttgggcacaggctcgctgatcaacgatggcaacagcgtactgaccaaccaacacgtgcgcgacgcgctggccaaaggcagcaagctcgaactttggctggggtatgaacaagacagtgccgggcggatgaaggtggagcgcaaagtgccgctggcccccacgccgctcagtggcgacgcgcgcctggactatgccgagttgcctgtcgacttgcccgcaggggagaaaaaagccttggccgagcagttcccgcccctcaagttggcccccggcccccaggcatcgcttgggcaaaaggtatttatgcccaaccacgggcaagaggctctcggcatttcgtttttaaatgccaagggccagcccaccacgctcaaaggatacgaccagggcagcccttatcagggcacggtttaccatgatgccttcaagaaacccggcacttccggctcaccgctgatcagcgtcgacaccggcgaaatcgttgccttgcacaacggttccatcagcgccaacgtgaacgggcaccgcgcctccatgggcacggccacccgcatcgacctgatccaacagcaccgtcgtaagaggtga

SEQ ID NO: 27 - DNA, 1617 bp, unknown
  environmental sample
atgcagggtgctgtacgtggcaggcgatgcacctgggatgtgcggggtcgaccctggctgaccaacagtgggcacgccggcaccatcgtgattcttgcgggcaaggacctggtccccgtcgcgaagaattcctatggcgttggcgcatccacgcagaagtcaaagaggtccacgcccatgtcgtcagaattccgtaattcccatctccgtaacccggtcgctccgatcgaggatcccggcaggcgccgcctgatgcagtccgcgctggccggttcagcctgcctggtagcggcaccgttgctggcccaccaaggcttggtggattcatggggtgaacccattggcagggaagccaaagccagcgccggtgacgatgcgctcacggtcctgcgcgagtcactgctggcagggctgaatctggtgccggtagtgggcggcgtcctttcctacctgggcgcgctgttcattcctgccgtcggaaactccgcagagcagctgtggcgtgagattgtcgacgcgcggatttccgaggcgctgttgcaattggtgaaggctgatctctttggcctcactgggatagtgcagctgtacgccgatgcggtgcgctccggggacctggtcgcgatcagcacgcagagcattgccgccaatacccagttcgtgggcgctgtgccccgcttcgcccaggtggggcaggaagtatcgttgcttcccctttatgtcattgccgcctcgctgcatcttgctttgctgcgcgacatggcattgaaggcggtcgacctgggttacacgccggcctatcgcagtacgctggaagcacaggccaaggactgcattgcccgttacaccgcgcatgttgaccgatacgtcgccgccgccatccaggcggccagggtgaacaatccctacgactggcgcaagggggattactacgagagcaacaagccgttgacgcagatgctgcaggtaaaggcagcactgcagatcgccgtcatcgacatgcgcgatacctggtatgcgttcgacccggtacgcttccccgcgccggtcgcggtccggctgaaccgcgaagttctctctccaatcatcggcaagtgggacaggaagaatatttcgccagacgccctgccgacgtggcagccgccggcatcgcggataaaagagctgggattgagcacattcagcacagccggcggtgcgtcatggctccagggaatccacgtcgtgtaccaggatggatccgagctggaaaccgggtctcgtgcgacccaaggcaaacgcttgttcctacggaacacatcgttccatttgagcagggtcagggcgagatacctgcagggcattacccgtctggaagtcgaccataacaacggaacgttctggcagggtggcggtcccaactccggcgccaatacagcctccatcagctacacggggcatcgcgtgtcatccataaggtcggtgggtcatggccgggcgcccgcgctgacctcagtgggcagccttatcgtgggcttccagttgctcaaccaggaggccgtcccgatcagtctgcaaagctacgatcggctggcgcccaacatggcgccgcagttgctcaggtggattgcggactga

SEQ ID NO: 28 - DNA, 2619 bp, unknown
  environmental sample
atgaattataattttactcataaaatgaaaacgaaaagcattcaaactctgtctgtattttttgttttaatatctttttttagttattctcaaaaacagaaaaggttaattacaaattatattcttaccaatcaaattcgggattttaaaaaatccgatttaatagattttggtattgataatgtagaccaatccaaatctttaaaaggtgaaattgtaaaaattcagcaaaaatttaaaagacttcctgtttataatgcagtcggaacagctttgattaaagatgaaaagattgcgtacttttcaagttcatttttaaaaaattataatacttcaacatcaaatattgcaactttaaataaagaaaaagcacttgaaagaattgcaattgctttaggaaaagaagatatcaaaagtttccaaattattgaaaatcctgaacctgcacctgcacacagaaatttcgtaaagcaaaatctaacgtttgtagaggttgataataatttaaaactggcttatcaattttatttacatgagccaaaatctcaaaattcatggaacattttagttgatgccaattcgggagaaattttaaacaaagaaaatcttaccgtatcatgtaattttcatccagacgcttatggtcatgatcattctaatgaaaagttttctgaatctataaataaaatatttacatcttcaagttttctggcgcccgataatgcttcttacaatatatttccacttcccatagaagcacctttttttggaaatagatcagtcgttaataatccatggatattgactgcgtctcctgagggctggcattctgacgtaactaatcattataccaatacaagaggaaacaatgtttatgcttatgaagacactgcaaatacaaatcagccgggattttctccggatggtggagcaagcaggaattttaattttcctttttcagtaaacggaactccctcatttaatcggaattctgcgattaccaatctgttttacatcaacaacagagttcatgatattttttatcaattcggatttacagaatctgccagaaatttccaacaaaataattttggaaaaggcggagcaggaaatgattacgttttagctgaatctcaggatggaggcggtttaaataatgccaatttcaccacaccttccgacggaagcagacctgtcatgcagatgtatctttggtcgacagtgaacagatattttttctataatgctccggcatcggcaattccgagaattcctcaggcaaaccctgcacagtttggtccgcaactcaatggaactggtgttacgggagaaattgctttagcttcaaatataaatgggtgttctgcattgccagcaggatctttagccggaaaaataggacttatagaaagaggcggaaccgcaaattgtacatttgctgtaaaggtgaaaaatgctcagaatgccggtgcaattgctgcaatcatttataataatgctgctgcagttaattttccgtcctcaatgggcggcactgatccgacaataacgataccttcagttttgataacgaatgatgaaggagaatatgttaaaactcaattaaacaattcagtaatcgtaaatgtaactttaaaaagtgatccagcaactgctcttacacctgacggaagtttcgataacggaatcattacccacgagtacggtcacggaatttcaaacagactgacaggtaacggatccacatgtcttttaaagtctcaaagcaaagagcaaatgggggaaggctggtcagatttttttgcattaatgcttaccaacagacttggtgataatgcgaatgttccgagaagtataggatcttatgcaagcggacaatcaacgaatggtgctggatttagacctgcaaaatattcaccggatttttcaattaatgattatacatacggagatacaaacggaatggagattgaggaagattcagaaattgttcccgatgttcaccggatcgggtttgtctgggcaacaatgctgtgggatttacactggcaatatgctgcaaaatatggatattcttcggatgtaacttcaaacatgagtaacggaagtgcaagagttttacagttggtaaccgatgctttaaaacttcaaacttgtaatccaacatttattgatggacgaaatgctattttatctgctgaaatgcttaccacaaaaggcgaagaccgatgtatgatatggaaaacttttgctaaaagaggtttaggtttaaatgctttagccggaaacaaaatgaatatcagtgatcaggtggaagatttttcaattcctaaagattgtactgatggaaactcaaatattgcaatcgatagaagtttagtgaaaatatatccgaatcctgctaaagatgagttttttatttatttaaaagattataccatcgggaatgtccatgttcagatttatgatatgtcgggaaaattggtgttgtccgagaatagatcttctcctgattcaagaattcaggtttcaacaagagactttgaaagtggagtctatgtcgtaaaattgcaaggcataggaattgacatcagttcaaaaataattatcaaaaaataa

SEQ ID NO: 29 - DNA, 2031 bp, unknown
  environmental sample
gtggaaataaaactttaccccaacaaattcttagtaagatttctagtttttgcctcgattgttctatccgtaagcagccaactatttgcgcaacgtttcaattccgttgttttcaacaaacttccgcaagattatcagctctatcccagagatgggcagagtgagggtatcgtcccgatttcaggcgtcgttgaagtgaccggatacagttatgtatcggtacaggttttccgcaacgatacgtttgtcaaatacctcaaagcgagccttacatatgacaacaagggcgtaggatcctttgcgatggaaaccaggataaaggccgaactggctcagtacagttttaaagtttttgcatgtaagacgatcgactcaaccctgatcgtcaccagaaaaaatgttgtgagcggcgatgtttttatcgttgacggacaatcaaactcgactggtttttttgatgaagcatccaccgatccttactgccggacttttggaaaaattaccgatatcctgaatactacaccatataatcctgcggacacactctgggcgctttccaatcagcaaaaatatctgacgggcgttggtacaatgggatttgaaatacaaaaacaactttctcaaaaatatggtattccaaactgtctgataaacggcggatttcactggtcttcgtctgtgaaccatgcgcaacgcacggaaaataaccctgcagatctgaacacaggttatggccggatgttatatagggttcaaaaagccggtttgcaaaatgcggttaaatcttttatttacagacagggagaatcggaagcttaccacgagggctctgactggccgggaaatttcaaaaaaatacgaaataacctgaaactggattttcctaaactcgaacagatctatgttttccagatcgatattatttacttcccttcaacgacgggagccgaactcagagaatatcaaagaagattgcctgaactatatcccgatgttcaatcactggcaacagttggaacgaaacaattcgatggattacattacggcccggaaggttacaggcaaaacggattagaggtatccagactaattgccagggatttttaccaattaaaagatacagttaatattaattctccatcgttaaaaatggcgttttatacttcacaggagcaaaaacaattgattcttgtttttgacgaaggacagcaacttgtttatcctgagccttataaggtaaacgatcagcttactttactaatgaaggatttcatttatctgaatggattccccgcaggaataacaacggcaaatgcagatggcaacagaatcattctggactttgccaattcgcaaaacgcatcaagatttgactatctccctccttacacattggagacgaattatttctatccatacaacggtccatacctgactaataagttaggaatgcgcgcgttcacggttaataatttctccatcgcaaatggtcttaattcttcaaatttaacatcgtcggtaaacccatttgcaaacgcagttttgagctggactgaggtaaatggagcgactggttatacgctcgaacgtaaactggccggagagaatgattacacgatcgccggtaaattttcggcatcttccagaagttttgaagacaaaaccagcagtttccccggaaaaatttcctaccgtttgaaagctggaaatagcatttcagaatcttccgcatacgcctacgcagaggttgaaatccccgttattctaggtctggaagaatcgggcaaagacttgtttgaagtctttccaaatccggtagtcaaccgtgaaaatgtcacgattcattttctaactcctgtaaaaggctcaatccttcttatcaattcgcttggtcaaattctgaaaagacagactgtaaaccgccagccagaggctgatctttttttacaggatttgccttccggtacctattttatccagttacaaaccgaagataaatcacttacaaaaaaactccctgttgttcgatag

SEQ ID NO: 30 - DNA, 2946 bp, unknown
  environmental sample
atgatcgagcaccccttctccctgttacgcaacctggcccgaaccgggaacgacacgcacgaacatggcgatgagacgttatcgttcatcaacgcgatggaaaaactgaacatccattcagtgttcgatatcgtacggcgctccaaaagcgcttttgttcacgaactctcacgtatcagtgatgctggtgcagcgctcgcctatgaaaacgctcgttgttacgccacccagatcgtgcgcctgtatcgcaatcaactgctgtcttcaggccgaacccaacagctgacgcagcgcaccggcgtgcgttcgctggtagacatcgggcctggcttccctaatctattcaaggagaactgggatctgttttgcaaggtgggtgcaatcgaggcaaaggattcacccgttgcgtacctgacgtccttgtatcgctttgctctggaacagctggaaggcagcgtagcggaaccgagccgaatcaagctcgatgaacgacggcctgacctcaaggatctgttgatcgatcaccaaagtaccttcacgccagtgcctacgctgcatatcgtcaatcaggtgttaagtaaagccatcaacgcctacgtgggcacagtgcctgaggacaagggcaagactatttaccaattggtggccgaaaaacaacacccgtttcagtttccttacaactttcactttcaacagatcagccttgggcttgacgggaagaaaccaacgctaggcgaactgagttaccgcgtcagccttgaagttccaaccacgtcaagatacggcagtgactatgggaaagtgcagcactccagtgccattgcacaggtgctgatgagcggagcaggcccagagcaacaggcaatcgtgcttgaacctgccttatccagtcaggcaaacgccgacacgtcggcagacctgacccgccagttcttcaaaacgaaatacaacgttgattacgtcgacgacgccagcaatcctttgaataatctgaacgccttcctggagaagacgggtctggacagcgacggagtcgaagcccttcttgccataggcaaccacacggcctatgcctctcccaacatcctgtcagcgggacacaccacggatgaagactccccacgcgaggcaagcctgacagcaatcaaggctcgattcggagctggctacgtcaatggcccgaccactcagccggcaatggctctgaacaaggatgcgtacggcattaagcggctggtcaacaccagcgtggaccgcttcgaccgcctgcaacgcatgatccgtctgcagcgctggacgggcattccttttacagcgctggacacgttggtcatggccgtcgttcgctccgaaggcgccgtgaaccctcagatggtgctgacggtaaatacgctacgcgcactgggaacctatcggtatctgaacaaacgttacggtctcgcgccggatgagtttgcagcctttgttcaccagatgcccggcgaggcaaacgacggacgcttgccgatgttcgaccgggtattcaacaacccggcattgttcgataccccgctggtgttggatgggtcgactctctacctcgatcagcacagtagccagcacgtcaaagctcgcgctcagttgagccgagccttgcatttatccagcactcatgagggcctgaggcagctggccatcgatgttcgcgaactgattggcaacgcgcccactgacttcagactcaacttgagcatgatctcttcgctgtaccgccaagcccgcattgcttcgatgttcggtctgaccaccgcggaatgccgggcattaatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaacgatgcgcgcttggctgtactgaaaggagaccagctggcatcccttgacttgccaagcaaggatgaccaaaacaacaccctcaattggtgggctatcctctattaccacctgatcgacggatttgggctggtcacgactcagccgctggatgaggaacctgcggtcagcatccgccgcaccctgcatgaacgcttgtcctcaatagccatcgcggaaccccttgcaagcgaagtcgaagccagacttgcaacgttcgtattgaacggctatcggaatcagcatcggctggtggaagagctgttgctgaccctcaccggtttgccgccggaccgttgcgagccggtgatacgctgggcaggcagcgacgtaagcaagtttctcgctgcgttactttgggataatggcgtcattgagacactctcgatgctgattcgctattcagaagtcagccagcaactggggctgagcgcccgggcactgcgcacttttttgatcaatccacgctggctgtacgcaggctcagaaggccagttttatctctcaccgaacagtctgtatttgctcgaccgttacagcaactggcgcgacaactgcggttacccggaggaagcgctgcttgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaagtggactggttaagccggatgcacagcgccagtgatgtcaccggcctttcggcaagacaattactgtcggctaccgacctgacagcgaccagcacggcctcgcactggaagtccgtaggcgaagccgtgatagccgccaaccgttaa

SEQ ID NO: 31 - DNA, 2784 bp, unknown
  environmental sample
atgcaaaccgacagcagctccttgctcgcccaattgattgatcacacacgccctcccgccccagggcgggacgatttcaagaccgccctgcggcgcctcaacatcaactcggtattggacatcgtacgattgtccgaaggggcctttgccgagcaactgaaaaagtacaacgatgacgacgcccacactgcgtatctcaaggcccagagcgctgtagcgcaactggaaagattgtttagcgaacagcaagtctcgtcaggccgcccttccctgcgcgacaagcgtggtttctctgccgacaccagcgccacctaccaggctttattcaaggaaaactgggaacagttctgcgccagctcgtccattgctgcggtcgactcaccggtggcctacctgcgcgcgctttatctgttcgccctgcaactggaacagaatgccaagggggagaacacgatcaagctgtcggaccggcgtgcggacctgaaggcgcttttgatcgaccaacacagcgttgcgggccaggtgcccatgttgtcgatcatcaatcagaccttgctccacaatatcgcaggcgccactgacgcttacacactgctgagcaagacctggtacccattttcgctgccctatcattaccaccaccagcagtgccggctgggattgtcgggcgacaagcccatgctgggtgagttgaactatcgcatcagtcgccagttacccctgaaggacggcaccaatacgtatgggcaagtcattggccagaataatgaggttcaatgcctgttatcagggttgagtcccgaacaacaaaccctgctcaagagtgactgggtagcggcgcaggatgcgccaaccttctatagcaagtacttcaattggacggctgaaaaggggccggaaaacgtcactgactttttgcaccatacacaactggatgccgaacaacttcaagcgctgctggcacaacagacacaagctgcgcgcaaatcgcccaactacaagcaggacacccgcttcacctacggagcctgttacatcaacggcgcgaatgcccccgcagccgcgatcagacaggacaaagggggccccgccaagctggataacgtgagcctcgaacgctttgacaggctgcaacggatgattcgcctgcagcgctggctcggcctgcctttcgcacaattggacactttgctggtcagcgccatgcgctgcgaaggcgccagcaaccgcgcgctgttgatcacccataacacccttcgggcgctgggggtcttttgttatctgagcaagcgctacaacttgcaagccgaagagtttgccgcctggctccatcagctacccgttcacgcctcgggtgagcgcgtgtcgttgttcgatcaggtgttcaaccgcacgggttctgccttaccgcccctgtatctggacggcaaggtgttcgacgcaaccactgagcaacaactttgcgccgggctgggtctgcaagacacccaggattcgctgcatctgctgatcaccgataagcctgcaacccgtacgatcgagaccgtcagcgcactctatcggcaagtacggatcgcccgtctgttcggcttgtcggtcatggaatgtcaacaactggcgcagttgctcggtaaaacaaacgttctcacccaactgcgcaccccaacgctgcgtcgcaagcccagaggcgcgactgactttctcgatgtgctcatgaacctggaatgggccagccgctggctcaaggaaaacggcaacagcctgcccctgttcaagcatcagctattgctcgatcggcaggtccaggacccagccatcaacctgctggtgaaagcgttcaatgcctatgaccaggcgtctctcgccacacagttgaacctgcttgagctgccgcaacaacccaaggatgaagaaaatcgcttgcccatcgttgactggaacaccctgatccctcaagtactgcaaaatgcgcgatcaagcaccagcatcgagcaggcgctcgatgaagtgctgtcttccgttgcaatcagcacggactccaaacgcaacaccgtcatcaaagaccaaacgaaaccgaagctgctgacactgttgaacaaggtgcgtgatgagctctgggcactgtatctgcggctcaaagacatcatccacgcagtgccccacctgccaggcaatgccaacgggcatcaaaaatatgaacatcaccgccatttcctgcgcttgtacgcacccgctgccccgccgctaagaaccctcagctacttgatattgctgctccctcacgccgtcgatgttctgcaattgccgctcagccggcacgcgcttgatcaattcataataaacccgcactggttggacagtgactatcaagcgtctgcgttacttgaactgaccccacacaccctctatctcatgcagcagttcaaacattgcatcgaccgcctgggcatgacggaaggacaagttctcgactatttcagacaggccaacaccccacccgatagcgtggcacaaaataacagtgaagaaacgaacgagcatctggctcggttttgtggctggagtgccggcgaaataaacgtcttcagccaccaactgaaaccgccacgcattacgtccatggatcgcctggagtggctgctacgctgccgccacgtcagcaccgaaaccggcctgtccgccacgcaactgattgcagccagccaacttaaaagcgactcgacgttcgctcaatggcaggacgtcggcgaagccctcatcagtgcgcatacatccctccattaa

SEQ ID NO: 32 - DNA, 2781 bp, unknown
  environmental sample
atggttgaacgctcgaatgcccttcatcagcacacgccggcattacagttggtggacccgcgcggcttgcctgtggggtcaattgcgctatgccgtacgagtagcgatatcgagccgcaaatccttaccagccatgcgtcattcgacatggcggggcgacctgtcagctgttgggattcgcgcctgtgggctgatcgggcgcccgccaatctcagcgtcattcattcgctcagcggtcaggtgctggccagtgacagcgtcgatgctggctggcgagtgtcgttagcgggggaggccgggcaggcgctggtggtctgggacgctcggggcgttgtgcgacgcatcgggtacgacgcgttgctcaggcccatcgaggtttttgaagatgagcactgcgttgagcgccttctctatggcggccctgattcgactgatcacaaccagtgtggtcagttgattcgtcatgacgatccggcaggcacgcggcttgacgatgcgtatggtctttcgggaaatgtgatcaggcaaacgcggcgctttctgcactctgccgatgagcctgactggcccgagtcgctgaccgggcgtgatgccttgctggagcccggtgacggcgcaaccacgtgctggcaatacaacccgctgagcgagatcacctggcaacgcgatgcgcagggcaatgttcagtgtctgggttacaccgttgcagggcagttgaaagacagtcgtttacagctcaacggtcaggccgaacaggttctggtcagtgccatccagtatgacgcgcaggggcgggtggtgtcggaaacggctggcaatggtgtgatcagcacggcgctctatgccgctgaagacggtcgcctgggggaattgaataccacgcgtagtaatgggcagtcgttgcaggatttgcgttacgactatgacccggtcggtaatgtaatccgtgtcgatgatcgtgctctgccagccatctccaaaggtcagcgcatcgactcggtttcgacctatcgatacgacacgctttatcaactgatcgaagcctcgggcagggaatgggcagtcgttaatcacggcccggtgctgcctggtttccagagtcccgccgatccttcgacgctggctgattacacgcagacgtatcgctacgatgccggcggcaacctgcagcagcttacccatacaggcacgcagtcccattcgcgcacgctggtcaccgcacgtttcagcaaccgcagtctgccggtgatcaatggccacatacctgacgaagcagaaattgctgctgccttcgatgccaacggtaatctgcttgcgctgcaagccgggcaaaacctgagctgggaccgacgcaaccagttgcagcacgtgcgccccgttatccgtgaaaatggtatggacgacagcgaacgctatagctacgacgccagcggccagcgcctgcgcaaggtgcgtaccacgcaagccaaaaccattacccatacggccgatgtgcgttacctgcccggtcttgaaatccgtaccgatacggccactggtgaaaccctgcatgttgttgtggcccaggccgggcgtaataacgtgcgcgtgctgcattgggcgtctggaaagcccgacgcgcttgaaaatgatcagactcgttacaccctgaacgaccacctggggtccggcacgctggaactggatgggcaggcgcagcgtgtcagccacgaacgttattacccgttcggcggcacgtcatggtgggcggggcgtaatgcgatcgaggcgagttacaagaccgtgcgttactcgggtaaggagcgggatgcgacagggctttattactacgggctgcggtattacgcgccgtggttgcagcgctggatcaatccggacccggccggtcttgaggacgggcttaatttatacggtatgttgagaaacaacccgctcacgttcatcgacgcggtgggaggagtcgctgaaattcccaagcatattcactacatctggttgggcgctgctgaaccgctgatggagcacctggaagggatcaaaaacacttctgtgctgaatcccgactatcagttgacgctgcatctgcatctggatctgcgaaaaggtgatgaaacggaaatagcctcagcgctgcgcgggcgaagaaacgtccatatttccgacctcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcagggataccgatttcattaccaagcccaagaggattttcacgatgcgcccgacggacacaccttggaaccgggatgaaatcgtgattaacaataactcgttcgcgtcacctgccaacaatccggtgctgagcactttggaaaaggagatagtcgaccggtacagcgtttatcgtgagacaggccttggcaaggtgctcagtagcaccgccgatgttagcgacaggatgagaatcgtttctgctgtcacggggcccaaggtgttcacagaggtattgcttaaagaggggcgtgggctaagaaagctgttttcaacaatggtcaattaccatgttaaaggtgaaaaattaaaaaacccgaagcgttatcaggcagaagcccaaaaaagaatgccactctcgaacttcataaaaatgggaggcagccactcatggcaatag

SEQ ID NO: 33 - DNA, 1413 bp, unknown
  environmental sample
atgatgctccgcccatcggtcttgaaccggcgtcgtttcctcggcctggccgcgctgggaggcaccggtctggccctgcccaccacctctctggcacagcatctggaggcggcgcccaccgcaaccttcgatggcgactggtggtggggagcctttcgcgcactcaccttgaaggcactggcagccgtgcctgaggtcggcggcattctctcgttcttcggcggactgttcattcccacccacctgttcgacagtgaggatgcgcaatggcggcagtacatcgacgcagtcaaccggatcgttgaccagaagctcgacgacgcgatctatctccaggtgcaggcatcgctggtcggattcacccgcacgacgcgcttgttcctgtcggcgctgcagaccggcgatgcgcagcacatccgcagcgtcatcgatgccatgaacgtgtcattcaccgcctccatccaggggttcatgctgaaaggccacgaggcccgcctgctgcccttgttcgtgccggtggcgaacctgcatctggggctgttgcggcaggcggtgcagcaagggcatcgtcgcggctttcctgccgccgtgatcctggattatcaggcgcagctgcagtccggcattgcggattacggtgcctactacgatgccgtcgtcgagcagcagctgcaggcgactgccaaggcgcatcctcacgacggcgggcgccatcgcaatgagccgttggcgtcggtctacacgctgcggagccaattgcagatcagcctgggcgacatgcgcgactgctgggcgtacttcgacacggcccgctatccggatgccatacaggtgcggctggatcgtgagcttttcagcatgttgatcggctcctattacgacgacagggtgcctgagccggcaacggtgacgcttccagtaccacccaccgggccgatccgcagcatcacgctgcagggctacgttttcgtggacgggctgaccctctcctacgctgccgggcaggggcccgatcgcgtcgatgcggtgcatgtcggcggggctggcggggcatttttcagcattgacgacatcgtcgagcgagggcacgtccgtgcggtgctggtgcagcatggttacgcggtggataggctgggcctggaatacggcgacggcaccctcagtggcacagtgggcaataccggcaaccaggatcccgccgcgcgcctggcgttcccgggccaccatctgtccagcgtgatcggtttcggtacggcggccggctacgggggcgtgctgtccggctgcatgtttggcttccagctcgatgagcccagcgcaccggtcgcgttcgacaggcgggtgcaggaccgtctacagcgcgtgtggccgtccgggctgcaggcggcgctgcgcaggagtgcacaaggctga

SEQ ID NO: 34 - DNA, 1260 bp, Photorhabdus Sp.
atgcagacagaaaatgttttagacataagaaccattgtagctaatgaatatgctgtaaaaacgagtgcattagagtgggatgttactgatattgtaaaaaatgcaatcatagggggaatatcttttataccttcggttggtcctgctatatcttttttagtcggtttattctggccccagtcgaaagaaaatatatgggaagggattgtcaaacaaattgaaaggatgatagaggaatctgcattaaagacgattaaaggtatccttgctggtgatattgcctatatacaagagcgaatggcaactgttgctgatcttcttgagaaacatccaggatctgcagaagctaggaatgcttttaataacctggcagaaaatatagatggttatcacaaaaaatttaataatttttcggatgatgttaattatcagatattacccatgttttctactacggttatgatgcagataacatattgggttgcgggtttagagagaaaagaagaaattgggcttagtgatattgatattgaaaaagtccgaggattagtcaaaaagacagtagaacaggctaatagttatatcaacaatatatatgatagagagcttaatgatgctcttaataattcgacggctgacactgttgtaaataatgttatgtctgttcatggtcactgtcgtttacatggaattgaatatatcagtatttgggatagattaagtgaaactgagtctgtaaataatagaatctatgttgatgttttaagttattctactttctttgaccgtcaaacagcaaaagccagaattcaggcattgacgccagagaaagatatgactccacctctcaaaccggctcttaatggaggaaagagaagaaagataaattcgttaatggggcatattgtacgtattggaggggcaccaagagtaggagggctgacagtagtatttgatgatggtagtcgccatcaattaggtacaatatctggtgagacggcatctatttctctggatagtagtcgaattaccagtttggaagtatggggcaatggtgctgttgataaagccgtctttactttgagtgatggtcgttcgctatcatttggagaacctggaacatccagatataggaaattttatgttggtgaaagtcactacatttcagggatctatttgtccagtgattacagcccattagtcggtcaggcagcaaatattgctgtatcttatcagctgataaatgatgatgaaaaataa

SEQ ID NO: 35 - DNA, 402 bp, Photorhabdus Sp.
atgtctagaataaccatttttattgattcagatgaacagaaatcagaagtttattctaattctacggttccggtacgtaaagaattaaatacagtttttcctttgagtgagctgactatatcccctggttctagtgtggaagtatttagaatagatacaccaataattccagaatccagaagatctctgagagttgtaaatacaggactggcaagtcatgttacggctaaattttactggtctcatagttttacctctgaatggtttgagtctggttctatagatgtaggattaggagaagataaggtattaaacgtgcctaacaactctttttattatagtaaatttgttatctataataactcggataaagttgcttatattacggcaaatttggtttaa

SEQ ID NO: 36 - DNA, 909 bp, Segetibacter Sp.
atgagccttcaatatttagacaagcgacttatcggcgccataattgttgatgcgtggcaaaaccactttaacacagagatggaccctgccgatggacagtggtttacgaatggacccgggaacaacggaggtctttatggtatattaacagatacgctcgcatctgaattaaagttcttacctgatcaacaagtttttacaatgaataagatagcggctgctaccagcacagccgataatcgaaatggcctaacgcctcaccagactgtttcactaacatatgaatatcaaaattctaccacagtaacacactctactaccaacactataactgtaggaacaggtgtagaaattaaaagctcggcggaatttttaggaacaggcgcagaagttacggttagttttaatactgaatacagctactcctggactgaagagagaagtgagtcggtctcagaaactaaaacgtttggacaagaggtatctaccgacattccctctggcctggtttaccaggtaacactgcttgccgacaaagcaaatattagagtgcccttttatgctgatataattcttactggacagtctgttgcaaactttgcaagccctgttaatggacaaaaaacctgggctattgatgcaggtactttatgcgaatggattaatcaatatggatcagcaggtaacgagtcgtatagatacatgaaggatgcgagtaaccccaagcaaggatttattcggctggagggtaacctgaccgctactcaaactttgaatttcaccgcattaacaagtgatattacagattcattcactgcgacagctcagccagctcttatgcgtgagttgaacaactctgagctagaaaaattagaatctaaggctattaagaaagtagccctgggttga

SEQ ID NO: 37 - DNA, 1365 bp, unknown
  environmental sample
atgcaacaacctaaagtgtggtcggaatatggtatagaaggttgtatttactacgaagataaatatggttatctttctcttaaaacagatggtaacccatcagaacataactggtattttccctctgatggtacatcaaataaccgatgggattttatccagtggagagcggggatatttaccgatcctaagcaatggggggactcaggagcaaaaggggacatctattacagcaaggaatatttatccttcttcatactgcagaagaacggcaacccatcagaacataactggtattttccctctgatggtacatcaaataaccgatgggattttatccagtggagagcggggatatttaccgatcctaagcaatggggggactcaggagcaaaaggggacatctattacagcaaggaatatttatccttcttcatactgcagaagaacggcaacccatcagaacataactggtattttccaacagatggtaatgataatgctcaatggatagtgaaaggcaatataaaaaagcaagagtggattaaatatattaatgatgagcgtccgataaaccagatttctttgccgggtactcatgactcagcaacttacacaataggtagtgcagctatcgttagcagctatgcaaaaactcaggacgattcaatatttgaacaacttgaatcaggtataagatttatagatgctcgctgccgtcatatttctgatgtttttgccatgcataatggtaatatatatcttaacattaacttcggaactattttaaatgattgctatagattcctggaacagcatccagatgaattcatactaatgtcagtaaaaaaagaacacacagaagaaaataacactcgttcttttgataaaactttcgaaataaaatattatgattcgtcgagatggttcgtggaagaccgcatacctaaactcaaagaagtaagaggtaagatagtattgttacgcagattttctggtggctcgctaggagtaaatgcagctagctggccggataatcagacctttaataccgaaaataaaatacatgtgcaagacgagtacaaccaacataatgaggcaaaaaaatggcatgcaattaaaaacgcttgggacttcggtgttgataattccaaaaaaggttggctagttcttaattttacgagcattgctgccgatactttcacctcgattagatcttatgctctggataaaaacccggaaatggcgaaatatataagtggaaccaaagctaatggaggggttgtgatttctgactttcctaaaatcggtaagatagcagaaaatgtcataataactaattttggggaggtggaaaaattctaa

SEQ ID NO: 38 - DNA, 1206 bp, Acinetobacter Sp.
gtggatatacctaatagttttaagtttatgcttagctgcgttacttttacgatagcaatatgttgttctaatctagtttttgctggtgctgctgaaaaatggcaatatgatgttattccagataaatctaaaaatatcattaatgtaactgctaagaatattactcaaaatgctgctaacgatttaacttataaagtcaaagtggtacctaatagttctatcgttggtcgtactgtcttaagacgattatttagtcgtaatgtggctgcttttgctactgtcgcaggtattgaattaactttaaaatcattaggttattctttagattacgatagtcaaactgtttatcgtgaaattaaaactgattcagatattggttggattgatcttaatggtatttggcataatgatccaaataaatggggtaaagcttgggtagatacttataattctaacggtgcgactcctaaagctgtgttcaatcgtgtcgaactcgatgagaagaatactgcttatctttgggttgatcgaacttatggagcagagacatatacctcaaatgttacgtcatccgcatctcaaccgaatccaaatccccaaccaactcccaatgtccgtgaaattttaaatcctgaagcgattggcgatatagttttaggtaatccaccaaaaccagttaattttagtccggaattacctttaccttcatatccgccagtatattcaccagaactatctaatatttttaaacctgtaccagatgtaaattatccaaatgatttagatccagcacctaatcaggtaatagatctattagataaatctcaaccttcatcaagcgatcagataattacaacaacaccaacgcctgatggttcatcaagcttattacctaatttctgtgattgggctacaccaatctgttcattcatagattggtttaaagacgattccgcaattcctgagcctgaaaaatatgaagtaaaagagtttgataagtcaaaattaccaactgcaccgcaatttagctttaatggtcaatgtccagcaccaaagatctttaacttaaatctgggtttagcatctactcaaatatcattgccctacgattatttctgctcattcgcaaccgatgtacgtccattcgtcatacttgctgcatggctacatgcatgttttatttttgctggttttgtgaggtcataa

SEQ ID NO: 39 - DNA, 3282 bp, Bacillus Sp.
atggccgatatgtgggtgctagatagatacgataacccgttggcaatcctatctagtgacgcggaggatgatgcatgtacctttcattctgatcagtttctggaaaagttgaatcaaggtacagaattctctttcagttgtgacgcaagacacgaagatagcctacatgtaaataaattaaaccaagtcgttttcagagatgaagacggcttttttcgtctcttcaaaattagagaaattgaccgcggcaatggagacaacggggcagagaaaatcgctcattgtgaaccggctgaaatggagctgcttgaagctattgtggaagacgtacggccaaccggtaaaacgcaacaatatgccctggatagagttttagaaggcacaaggtggaagggcaatgtaacggctcaaacgggaacacagtccacaaacttttatcatatcagcgcctacgaagccattactaaaattattgaggtatggggcggagagctgcgttttactgttaattttgatgaagaaaacaacaaaattattgaacgtgttgtcaacattgagcagcggcgcggaaatgatgaaggtgatcgtttcgaagtcggctacaatgtcgaaagtattacggtcactgaaatggcttatcctgtttctgctctatatggatggggcggcagcgtggagacagaaaatggcggggattcccgttatattgactttgcagacgttgaatggaaagtatcaaacggtgatccggcagacaagccgaaaggtcagaagtggattgagttgccaggagcaaaagagaaatacggttataaaaagtctgatggagcgtttataaactcttttggccaatggcaggatgaaaacataaccgatccaaaagagctattacagaaaacatatgaacatttgagggatactgcttccaaacctcaagcaacatatgaactaaaggtcattccgactgatcatatttcccttggagataccaggactgctatagatgatacacaagccgatccaatacaaattcaatcccgagttatcgccctaggatacagtatttcaaatcctgcaggcacaaaaaccgttgaaatgggcgagtttttagaaatttatcaacctgataggcgcctagacgatttagaagataaagtaaaaaacattgaccgcaatgttcaggtgacagatggcagtttccctgacattatccctaaagtcccttctaatgtaactattaaggggcttttttcaggtactagcatcacttgggactatgatccttcttcttatattgcagcgtatgaggtttatggatcgcaaacgacagggtttaccccgtcaatcgaaaaccggctatggcgaggcaagcaaagtggtttcctacatgaaaacgctggcgttgataatgtttggtactatcgcatccgagcagttaactatcacggcaaagcaagcgaatttacagctgagttttcagcaaaaactcagcggattatgaccgatgacattcttttcggtgcagtcacagcagacaagctggcaaatttagctgtaacagcggacgccatttcccgaaatttcgaagaagctaacattttgccgggatcgctattacgtttaagcgacattttaagggtcgattccagagtaattgtcaatgaggtaaatggtttcaatgagttatccgtaacgaaagacacaacagaatacacgtcattcggatttactacaggtggtagaaactcacttaagttaacgaaaggtgaaacttacaccttatcatttgagttgaaacgagaaacattgaatgacttttcatatatacaggtcaggtcgaaaagtggcacgcagtacaatttaacgaacaacttcaccgatttgtcgagttatccaactgatgaatttgtaaggtttgatcttccttttgtttccccagcaactctaactgatggtcgcgtttgtctaggagggagaacacaaaatctcacagatagcgctaacttcacaataagaaaagtgcagattagaagagggaacgtaagaatgtctttcggattcagcccatacgacacacaactcactgacggtgctgttacatctgccattattgcggatgcggctatcacaagcgccaaggtagcagaggcggccataggaacagcagccattcaaaatgcggcaattgcaagagctcatttacaagaagctatcattgacactgtccatatagctgatgccgccattacaagtgccaagattaaagagctgtccgccgatttgattacgtcaggaacaatcaaggcaatcaatatcacgggttcattgatcagaggcggaaaattccaagcacttaatacaaacagtaactttgactcttattttgatggtgacaagctatatcagtacaagatgaatagcaaaagtcaatatacaaaactagatataagctctagtttgatatatcaagaggctggggcagattattcaatcgacggatcaaagccggaaatttggcgaagtgtaagtatcggtaatgggaaagtttcggtaaaaggttcaggagaatttacgaatgcttccaatatggctgtagtcgaaatgtatggagattttaacggtgatggggatggtatagggaaatttgtaattagaaacgaaacgaacacaactgttccgtctgacattttcaccttagagggcgggtatgaccctatagacgtaaacgatcggtataacgcaaattatacaaacagagctaccataacaggtagttccacgctattgagtttgcagcctttgaacttcgaaacagttgttaatggtggaatacgcatgaaatcatcaaaacgtactgttttcgaaggagcgcccgttgaattacctaaaaaatcaacaataatgccgggcgatgaccaatttacaacgcaagaaaaaatagttggtggaaacgtaacatcactagtcacagacattcatggtgcgttacaaaataacttgatgatttgcattacacaaatagacgtgactttaggcgcttcgggcggggcttatgcatacgcctataattggtacaatatggttgatggtaactatcaaggagcggaaaacattttcgctgtaatggccacaccttatggcaagaatgcgaataacgtcaccgttggtataatgagccagagttctgaaaaattcgctgttcatgtaagggggacgggagcgacagacgtggcggcaacaacagtcacaataagattagctatattctacgaaaaaaaataa

SEQ ID NO: 40 - DNA, 2961 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatatgttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgcaggggtcatcttgttaagagaggatgagaatcctttagatcacgcgccattgcaagaaggacaaccgaaaaacttctctgatatcaaacaaccactattggaattacagttgatgtctaatgaaaccaaaatttctttatatggacgaagaagtgaacaacgcttggcacaagttgcaccatactcaagtgtccctttccatttgaccggtcgattttatgggcccgatcctaagtggatcgcggaaagtgacaatgaacaagggggctattatcaagattcattcgttcctacctatcgtatgattttacgatttgttcccagatag

SEQ ID NO: 41 - DNA, 3015 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaatcccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 42 - DNA, 1043 bp, Providencia Sp.
ctaccgcattaattgttgataagtggatatatcaaggctcaccgttatattctgcttatgatactaaacaacaattctctgatttttatgataaaggctcattttgtcagcttccacctagttatctttataataatccagcgaagaaaaatataggtttctttatgcggttaactcaaatttattttaaacgttcttctcgtctgaccttaattttttcaggtattttgttaacccttgtctttcaatttttttatcaaaagtacatccctcaacaagctgaatttattgataaaaacatgagttctatctatatcgactcttatcataaacatggaaataccgttttttataaatttcagacacctaacggtatttttacgctctctgattttgaaaagcagggcttcaccgtgaaacctgtcaatcattgcttggtaaacttactcaaaagtggggttaattatgaaatacattgtcagtaaatggcggtttactttgtaacgggtaagttaggctcaggaaaaacactgtcagccgtttacaaaatacgcgactacttaatgaaagggcgtaaagttgccacaaatttaaatatttcatttacgggaatgtttggctatcgggctaagaatattaatttagtccgtgtgcccgataaacccactgcttttgatttggatgcaatagggcgtggtaacacctcatataatgaggatttaaacgggttattggtacttgatgaatgtggaacgtggtttaattcccgatcttgggcagataaaagccgtcaagatttgattaattggattgctcacgcccgtaaattaggttgggatgtccttttcttggttcaaagtttgcaagttgttgataagcaatctcgtttaatgtttgcggagcatgttgtttattgtcggcgaatggataggttaaaaattccttatattcactggattttgcaaattatcacattagggcagtttcgattgcccaaaattcacttagccattgttaaatatggtgattctccaccgcattga

SEQ ID NO: 43 - DNA, 2772 bp, Pseudomonas Sp.
atgcaaaccgacaacagcccgttgctcgctcaactgattgatcactcacgcccgcccgctcccggtcgggacgatttcaagaccgccctgcggcgcctcaacatccactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgcctcccgcttcttcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggctcccatgttgtcgatcgtcaaccagatcctgctcaaaaatatcgcgcaggccaaagaagaagatacctataaggtgctgagtgaaacctggtacccgttttctctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacactgctgaaaagtagctgggtaaccgaaacgggcgcgaaagcgttctatcacaactattacaactggaagtctgatctgatcggaccggcaaaactcactgattttctgagccacacacaactggatgccgaccagcttcaggcactgcttgcactacagactcagtcaccacgccaatcgcctaactgcaagcaaaaaaccagcctcagctacggtgcgtgctacatcaacggcacgaccacacccgctatcagcctggacaacgccaagctgaccaacatcagccttgagcgctttgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagtttgctgcctggcttcatcaattacccgttcatgcctcaggcgaccgcgtgtcattgttcgaccaggtatttaatcgcaccgggtctgccctgccgcccctgtatctggacagtgccaggttcgacgataccacccggcaacagctctgcgctgggttgggcctgcaagacacccaggattcgcttcaactactgatcaaccccaacaagcctgcaacccgtacgatcgagacagtcagcgagatctatcggcaagcaagaatcgctcgcctgtttggggtatcggtcgtggaatgccgacaactggtgcaaatgctcgggaatgcgaaccttctcatgcagttgcgcaacccaacgttacgcaacaaaccgaagggcatgactgactttctcgatgtgctcatgcaactggaatgggccagccgttggtttaaagaaaacggcagcagcctggcgttgctcagatgccagctattgctggatcgccaggtccaggacccggtcatcaatcagctattgaaggagttcgccctctatgaccaagcgtccctttccaaagcgttgcaaccgcttgatcttcctcagcaacccattgacgaaaaagatcgtttacccgccgttgactgggaagccttggcctatacggcgctgcaacagatgcgtcccagtaacaacatcgagacagcgctcgatcacgtgctctcttccgttcaaatcagcacggcgcctgcccgtacgacacagttaatcaaccaagcaaagtccaagctccacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcgccgctgcaaaccctcagttatctgatactgctgttacctcacgccgccgatattctgcaacttcccctcagctcacaagcacttcaccagttcctggtcaatccgcactggctcgcgcgcaagtacaagatgccctcgctgcttgaactgaccccgtacaacctctacctcatgcagcagttcaaacactgcatccaccactgcggcctgacggaagagcagcttctgaactacttcgaacacgccaatgccctgcccaacagcactgcgcaaaataccagcgaagacacgaacgagcatctcgctcaacttttaggttggagtgccagtgaaatcgatgtgttcagcaaccaactcaaacctccacgcattacctcaatgaaccgcctggactgggtgctgcgctgccgccgagccagcatcgacacaggcctgcctgccaacatgctgattaaagccagcgaactgaaagccgattctgcgtttgctgactggaagagcgtcggtgaggcgatcaccagtgcgtatccataa

SEQ ID NO: 44 - DNA, 2409 bp, Stenotrophomonas Sp.
atgcgcaatgcgtcagaacgaaccgacatcctgtccgaatccgaactgctggcctggcttcgggtaaagccgcggacgctggaatgggacgcgctgctcgtgtacgaccgcacacgggccaaccgcctgctcctgcaggaatacatccgtcgcctgcacagcgaaagctttctgccgcccatcacccggctcatcaatcacgttccgggcgcgcattgggagtacatcgccgatcagttgctcgccgcaccgcggctttcgttcgaagacagcacgattaccagttccatggccaacctcaccatgcatgtgatgggcggtacgcagtggtccatccagaagcagccgaacggcccgcggcgcatcgtcaagatcgaggtgatcgacacgctgcaggggcccaagctgaccgggcacgtctttctctccgaagtggaagggtcggtgacggaagacggcaaggttcagatcaacctgcatgaggcggtggacctgcagttcacctatgccgacaccacgatcatgcgggagcaggcaggcgattatttccagcggctgtttgagcacctgcccgaggagcagcaggtgttcgtgctgaacgagctgggcccggtggacgagaacgacttcctcgatccgcacaccttcatgttccgcattttccgggcgaaggacgcgcagtaccgcgactcacccacctggggcgaaggcgcgattctggccttcatcaacggcaagggaaaccagtcgaaccaggggccgatcagcgacgtgggttgggtgtaccccattccggaaggccagtcggtcaccttgctggtcagcaatcgcttcctgatccgcaacctgctcgaaagtggcatccgcgacatggcagacggcaacgtcatcatcgaggtggagaaccccgacaatccctccgcaccggccggcacgatgcgcgcaggtggcttccgaaagcaggacctgctgcagtccgtaccggacgactatggggaagacccgttttttgactccgttcgctataccgcgacgtttccattgaattcgcaggggagccctcccggcgagttcgtggtgcggcacgaaaacgagcgcatcatcatggaatggtccggctcgacggtgaactctacgccgcagcggatgccgaccctggacctgcagtggcaggggaagtcgtgcaggatcaccctgctcgctgaatggcatttcaaacgggcctacgtgttcaccgcgggacaatatggcgcccgcctggaggtggatcgcgcacagagcatcgacgaggcaaaggtcaccccgctgacggtgagtccggagtacggcaacgaggtcatggatcactggctgccgctggcgcagttcaccaccatcagcctgctgctgaacagcttcgacaaggtcgccctgcccacgcgtgagattgacctgttccggctgcacagcctgctgttccagtccgagcattccctggtcctggagtccgggcactacccgacggacctggccatgttcggccagttgtcgccacaggagacctatttcgcggtcgaaccccaggagtcgttgatggcaccgggtgcgaaacagcagatgacgggcgtggacggggctgtctggaaggtgaaaggcgtgccgggtttcgatgacggggcagggtccattaccccgaccggcctgtacacggcaccggccgcgagcgagatcgccggtcaccatacgattgtggtggtcaccgccacccacggacgccaaaccagctccgccctggtgcgggtgctcaagcgcagcgtggtgtgcaatccgcaggtggtggtggtgggcatgggcggacagcaggtgaagttctctgccggcagcctggcggaaggggcgctgacgtgggcgctgaagtcggattccggggcaacgttgaaggaaattccactggacaacgatgtgccgttcgagccaggtgatcacttctacacctccggcccggctccgcagcgccacgccgacctgcttccggacaacttcatcgggatcgatgaagtcatcgtcacccatgacgccagcaaggccaccacgacatcgtacgtgttgacgttgctgctcgacgggatggcagaagtgagggtcatccccggatcgatgacggccacgcaggtgaagctggagatgcgcacctcggatccggagccgatcccggagccggactgggacgtggtgttgggaggtggttcggtggatgccgacgggcaatacacggccgacctggccgccgcgctgcccttcgcggtggtgcgcggattcaaggattacggctttccgggcgttccgcagttctgcggttacatcctgttgtcggtgccgctggtggacctggaagcgctgaaggaacacgactgggacacggacacctag

SEQ ID NO: 45 - DNA, 1737 bp, unknown
  environmental sample
atggctactgcaaatgacattaaattaaccggcaaccctgagattgaccaattcttttcagggggaattaggctattacctactgaaggtaacacttattattggcatatgccaaatgaggttcactcatccgttactactgtcgagcctattactaatgaattggcgaaaaatatggtcagagaagctctacaacaaattagtaatgtgataaacataaattttcaagaagttaactattctgttagcaacactggtggatttgatattctttccgggacagacctataccctatggaagggggaattagtcttaactcagaacaaagtgatgccaccattcaatttctcaataattattctgatacaaatacctcaattagttctaaagcgagaactattacaatgcatgaggtattgcacttattaggatttgatgatggtcctatttcccgcaatccggactatacaacagtagattccgtaatgtcatataattccctgattgacgataggtatggtgaaaaggtcagaagttatgtatacgatgaaaatggttcacagatggatgggacatcatgggctaccactgatacgcttggtatctatgatatacaagccatacaaagtatatatggtgctaactacaattataacgcgggtaatactgtatacaaatacacaccagagacgttaaagaactttcagactatttgggatggtggtggtattgataccattgatgccagtgagtttattttaggtgtggaactgaatttgaatgacggcacacgaagcaatttatttatcaaagactattcctggaacggatatgaatatgatggtacgcgtgcaattggcatagcttatggagctaatatagaaaacgcaattggtggtcagggaaatgatgttatctatggtaacgaactgaacaacgttattagtggaaatgatggtaatgatatcttatacggtgctgatggagacgatacactagatggcggttccggcacaaatactctatatggcggatcgggtaatgacaggttaatttccaaaggaagcgatacgttatatggcggtgatggtaatgacagatatgaaatatcgggtacagatttccgtatcattgaagaacaaaatgggggctttgacacgatagatatctattcatttgatgcagctacttatgttatgcctgagcatgttgaaaatattcgtttaaatacgggatgggatattaactcaaatcttactggtaatgatttggataattctattcatggtaactttggcaacaatattcttattggtggtaaagggaatgactcattggtgggatatagggggagtgatacttatatttttagcaaaggagatgggcgagatactatagacgaatataataataataacgtacccgcaacagatacagatattctgttatttaacgatatttctattgaccaactatggttctcaaagtattcctcttggggagatgagtctctgctaattaacgtgcttggaacaaccgatcaagttacagtctatggttggtataccaataacgctaaactggaacaaataaaaactcaggatggcgtgacattatcaatcgatcaaatagaatcgttggttgatattatggcaaatcaaacgatgcctctggcaaataactcaacgatcatcgatgattatttgatggtacaaacatcaatgattatgggttaa

SEQ ID NO: 46 - DNA, 1476 bp, unknown
  environmental sample
atggacacaaagaatgacaatactgtacaggggattccggtaaagagaaagatgaagataccactggatagcgccgtgccctccgggtacccgattcccaagctgaaggcacagttgaccgacctggggctgacctgtgaagagaccagtgaagagcagttgcaacaatacaaagatgatgtgatgaaggacttcaaaaccgggtccagaaccatttacggcttgtatcgcggcaaaccgaaagccaacttctacacgtccgacctgctgggtgccgatggtcggttccgggtgaatggcaatgagtttatgaatgctttgggctataccaagctggcggaaaacggtagctggaccctggatgacgacgcggagggctaccgcgccgagctgtgcaccataatttatgaggataatttcgagttcttgaagaccgattatccattcgattttaacgggcagaagaacagccagtcgcagacgatcaacgaaccgaccggcaaggccattgaaagcaccttcagctcaatggccaaagcggttgtgggtgtggtgcagtctggaatcagcagcgatgacctggaaacactggtgtccacgattattgacaagaatcagtcatccaatatccacgactacgaaatgaacgatgttctgattgcctatctggtcaatgactatgaccctgtcaagcaggaagccgtggcagtgggggccttgtccatctcctactatatccatatcaaggactataaggataagggtgataataaggatgggcggtataatgacgccattatccaggttaccgccaggtttgtctcctattcggacttggagtatatggagcgggacctgaaacggattgaaacccgcaccaaggccttgtttgaggtacaggagcagagccggtatctggtgaagggaaactgcttcaccttattggacagttcgggtggaatccccccgaaaactaccaagctggtggtctatgacaaaaaaccggcggcgaacgccactacgttccttaccggtctgcccctactgaacaaaggcaattatgccgatgtgatgatctttttctgcccggatttagtcaatgtagggtgcctggacaataccgattcggatgtcacctcctcctacagcaagagcgtgaccatcggattccagcagacggaggggatttcgatttccaccgagacctcgatggagctaagcattgaaattgtcaaggtcgggttcaagctgggggtcagcatgaccatgtcgaacacctggagcaaaagcgaaaccgagacagttggctaccagctgcctggcagaaagatggcatatttgtatcagggacagatggagagcattattttgcgttatgatccgtcaaagcaggcctatgagtatgtaaacagcagcctgaacaaattcctgacaaatgccgtgaaaaccacagaaaaacccatcatactggaatag

SEQ ID NO: 47 - DNA, 1167 bp, unknown
  environmental sample
atgcctcgtttacatcttcttttgaccggagcaattcttaactccgaagcgaataaccaactgaaagactcctgcttgcaaacggcaaccgccggactggtggtacagacgtattgcaaccaggttgccatacaaccggcctttaacctgcccgattcagtaaaaaccaaaatgccggatgtggatgcctatctgaccgccgcccaaacaaacgccaaccactacctgcgcaacgtgcagccccgaatcattgcggttattgccgatgtgggcggatactcaagcgagttcggcagcttctatggactgatcgatcaaaaaatacagcaatggaaaaccggctcggatgatgggaaaaaagatgcgcttttgctgttgaatcaactggaagtggatttgcaaggaaagctttcaaacgtcaagggcgttcagtccgacattaacagctttcaaactatggtcaacttggacacaagccattttaatgaagcatttcagtccgcccaggtcatcattggcggaaatcaaggagcaatcgccgcctataatgaacagatcggcagcctgaacaaacagatcgccggcgcgtcggcgggggtcggcttaagtggtctttccataattggcggcggcattcttgtatgcgtgggggtttttgcctcctctgtaacgggagggttagccaccggcctggttgtcggcggggcggccctggttgttgtcggcgcaggcggcttggtagccagctctatagctcttgtaaatcttatcaacgcaaaagcgaatctcattcaacaaaaagtcgcactggagcaaaaccttcaggcattgacaacctttaaaagctccatttccgacttgaaggacagcgcggcctcagccgctcagcaacttacgaacatgcataacgcatggagcttcttaggcagaaatttaggcgaagtcgtcacctcggttcgaaacgcccagacgtattcggaacttcctatagtcgtccaagcgtatctcaatacggcggcctcacagtgggaagacgtcaagggttccgtaaagacaattgaacggcaaatgaccggcgtttctacatctacactaaaggatggcaaagggaatccggcacagctcaccaaacaaagcataatcaactatgtaagccatgccgcctag

SEQ ID NO: 48 - DNA, 1383 bp, unknown
  environmental sample
atgttgaaactgatccccactatattgctatccctgatggtgaccgcacaagcgcaggcatcacagtgcagcggcgaaccgcttgcgcaaaacatgctttgcgccccggatgaaggcattgtgccagacacgggagccgatctcagcgcgcagattccggccctgctggaaaaaagcagcgcggagaaaaaagggattttcttcccggcaggcgagtacctgttcagccaggacgtggtaatgacctcctggaatacgctgcaaggctcaacgcagggcacagtctttcggggcatttccccaaccggtagcgccatccttgtcggtgatgagacctacaccaataccgtcaccgatctcacggtcagccatatcatctttgataatgcgcgcgtgggtttttacggccgtaaaaaccgcatcaacctcgcctataacgcattcgttaatacgcgaaccgccaccaatacaggccagcttaccgcctcaaccaacccgtatctgattcgcggtaacatctttatgcgcggcaatggctatcccggggttggccttaacacctacggcaacgcgccgggccttatcattgaacataacttcttaggctcgccagataagatgagcaaagccgcgccctggctgctcgatgacactaaagctttgcttgaaaccatgctgacgctgcgcgagcagggaaagctggcctttgacgacacacaggataaatttgtagcgggctggtactccaccagcaacctgcgcgacggtacgtttcgcaataacttcttctccggcagcaccaacagcaagctctataacccggataccggcgcagaagacattacccgcgatcacgcggtctacatcaagcagtacgataaggtggttgtcacccaaaactacttcggcggctggccggaggatgcctcagggcagcttaagttccgcaacgccaacggcctggtatttgccgccaactatctggacaatatttcgtttaacgcccggccctatgacaacaccgagccggcctggtggatcatgactaacacatttattttcaataactacgttaaaaacggcatcatcaattactggcagaacttctacgacaccgcagataaattcattaccgtcaccgactatctggtgttctcgaatgtgttcgacgtggagaataagaacgattgtctggtaagcggccagtccataagcctgtcggaagagttttatgagagtaataaccgatttagcgacggcactgacggtgtggtgacctgcggcgtgatgaacccgctttcactggatgacatcactgcccgcctgccggattacgcttctgagctgcttaatctgcaaccgctgaaacctggggcagactaa

SEQ ID NO: 49 - DNA, 798 bp, unknown
  environmental sample
atgttagtatcaatggaaaaatatccagctgattctattttgaaagactatccgctaggaatttatgacaatattggtattaatttggtaaaaaaatgggaaagggctttagtttcatttcatgtaagaaaaccctttcatcggtttgaggtagaaacagtagggacaggttttttattcgaaaatgaaagcgtggtgggtatatatacggcatctcatgtaattaaacaaattatggatgataaaacacgtactatacgaattaatgattcattttatttattaagtaacgttaatgtcttttatgaagatacccaagactatgcaatagttgaattgccaaaggaggcaatgaatggacaacgtatagttgcttttcctctagcacagcgaaataatcttaatcttactaagtcttttatgatttttggttatccagctaataaaaatgttttacgtttagggaaacagcatttgtttaataccttgaatatttttagaaatgattttaaatatgatactgaaacagaagatatattttttgagtttaataagaaggataaatatatttatgaacctgatagcagttttaagtcattacctgcactaaatgggatgagtggcagtcccatagtacaaatagtggttaataagaataccgaagcattgactcttcgagttattggtatttttaaaatacataggcataataataaagaaaaatatcttataggtagtaccttaactaattttgcagatgaaattaatacgatgatctcgttaggtgtattaacataa

SEQ ID NO: 50 - DNA, 3810 bp, unknown
  environmental sample
atggcaatcgtcgatttctacggcaacagtgttcgcctcggttccggcgtcagccgtgttgtcaacaaatccgcgcttgttggcggcgtcgctaccggaacggccgcagcggaagcgttcaatatcaacggtgcctttacgcttgccggcggcgctggggatgaccgttattactcggtctcacgtgacagcaagattgtcgagaaggcgggagagggcattgatactgtctatgtcatttccaactatgtcatgcccggccatatcgagaatctggaaatcggctatgcgagtggtgtgatcggcaacggcctcgccaattatatcaagggctcgctcctgtcgcagagcatcgatggcggcgctggcaacgacatcctgacgggcggcggcggcggcgatgccttcgtgtttcgcgccggttccggttacgacatgatcaccgacttccacaccggcccgaccgccgatgtccgcatcgcgccggagacggtccgcctcgccggctacgaacagttcagcagcttcgcccagatcaaggccgcgatgacccaggtcggcagcgacgtcgtcctgcgtctggatgccgacaatgccatcaagttcgccggcacgaccgtgtcggctttcaccaaggacaatttcgaactccgtttcgattcgacccagctcaaggcgtccttctccgacgatttcaacgcgctcagcctctgggacggtctggccggcggcacctggcgcagcgactatggctggggcggcgaccgcaatgcgacgatggcgcgaaccctagccggcaccggcgagaagcagctttatgtcgacagcgggctgttgtcgaaggaaaccgggcaggccatggggctcgaccccttctcggtgaagaacggcgtgctcaccatccacgccgcgccgacggcggctgatctggtcgacgacctgtcaggctataaatatacgtccggcctgctcagcacccgcaacagcttcacccagacctatggctatttcgaagcgcgcatggaagttccggcgggcaagggcgtctggcccgcattctggctctacaccaccgggtcgagcggctcggaactggacgtcatggaaagccacggcggagaccagtacggcgtcaccacccatgatctttcgaccggcaccgatgtgccgcttaccggtacggtcttcgtccccgatctgtcggaaggttttcatacctacggcgtgatgtggacgagcgagaccgtcacctggtatctggacggcgtcgccgtgcggaccatcccgacgccgcccgacatgcacggcccgatgtacatgctcgtcaatctggcgattgacgcgaacgtgcagtccgatttcgtcggtgccgacatgcaggtggactatgtccgcgcctacacgctggaggctgctccggcagcggttgatcggacggccgggaacatgatcagcggcaacactgtcagcggcggcggagccatcgactatctgagcggcacgaccggcgccgacaagcttgtcggcgtggctggcaatgacacttactacgtcgaccatgcgggtgaccggatcgtcgaaaatgcaaatgaaggtctggataccgtccgcaccggcatcgactgggctctgggtgcaaatctggaaaacctgaccatggttggttcggcaatccggggaaccggcaacgagctgaacaatgtcatctccggcaacgcgctgaacaacatcctgtccggcggggcaggcaatgacacgatcgacggctttgccggtgccgatcgcatgatcggcggtaccgggaatgacatctatgtggttgacaatgtcggcgatgtggtcgtcgaactcgccaacgaaggcgtcgacgtcgtcaccgcctcggtcgattacagcctgtctgcgaatgtcgagaatctgacgctgaccggcacggcgatccgcgcgaccgggaatgacgtcgcgaacatcctgaccggcaacgaactggataatattctggccggtggcgccggttcggaccggctcgacggtggcaagggtgccgacgcgatgagtggcgggcgggacggcgacacctacatcgtcgacaacgtccgcgatgtcgtgatcgagaaggccaatgaaggctgggattccatcgtcagcagcgtcgactatacgctgtctgccaatgtcgagcagctgacattgtccggcaaggctattcgtggaacagcgggcagcgcagcggcctttctgtacgggaacgaactgggcaacgtcctgaccggcggggccggtgcggatacgatcgatggcaaggctggcaacgaccggatcatcggcggcgcgggcaaggacaagctcacgggcggcgcaggtgccgacaccttcgtgttcggtgcgaacttcggagccgatacgatcaccgatttcaggatcggcgaagacagcatcgactggtccgctcttgttccgatctacggcgccccgaagatcaccaacgtcggccgcaatgtggtggcgaccttcggaaccaaagcaaacagcatcaccttcaccggcctcgacgccgctaatctggtcgcgggacatgtgttcgacgccttaaatccgttgggtaatccattcccggaaccgaccgacgaaccaactgacgaaccatccgccccggtggctccgccggtaatcaactaccccacgctgaccggcacgtccggcgacgacacgcacatcgtgtccgtcgccgacacacgtattgtcgagcaggtaaatggcgggattgataccgtcatgtcgtcgctggattatatcctgtccgccaacgtcgagaatttgcggctgaccggttccgcgatctcagcgaccggcaacgagctgggcaatatgttgtccggcaacacgctggacaacatcctgattggcggcgcgggccatgatcagctgatcggccttgaaggcgcggatatcatgcgcggcggcaccggcaatgacagctattccgtcgataatgtcggcgacagcgtcgctgagctggcgaacgaaggcaccgactccgtcaacagctctgccgactatacgcttacggcccatattgaaaatctcgctttgctcgggcttgccgtccgggggacggggaatgatctgaacaatgtcatcaccggcaatcttcaggacaatatcctgtccggcggcggcggaaatgatcgccttgacggcaggctaggtgccgacaccatggcgggcggtacaggcgatgacagctatatcgttgacaatgcccgcgatctcgtggccgaggccccgggtcagggctgggacatgatttggagcagcgtcgactataagaccaccgccaatatcgaacagctggtcctgaccggcaatgcgattcgcggaacggctaatgccaccggcagcatggtcatcggcaatgagctgaataatattctgaccggcggcatcggcaacgatatgctcgacggaaaggccggcaatgacacaatctccggcgggggcggcaatgaccgcattatcggcggtgttggcaatgatcggatgaccggcgggggcggcctggacacttatctgttcgccagcgacttcggaaaggacgtcatcacggacttcgacgttcggaaggacaagattgatctttcggtaatctcggcattataccggccgaccatcagcgaagacaatcataatgccgtacttcatttcgacacaaacacgattaccctactgggagtttccgtagatgatgcgcaacaaaatcaatttgactggctgagcatatcgctggccagtccatatgacatggcgtag

SEQ ID NO: 51 - DNA, 1827 bp, unknown
  environmental sample
atggcgacaaacactgtcattagcatgccttcgcagttattcactgcatcgcgttcttttaaagcactggcaaatgggaaagtgtacgttggtcaggtagatactgaccctacaattccatctaaccagattcaggtttacatagaaaacgaagatgggagtaaagttccagttagtcagccgttaataattaatgctgccggatttattgtttacggcggtcaaattgttaaaattgtcgctgattcaaactacagcatggctgtatatgatgcatatggaacgcaggaattctattttcctgacctactgaagtacaatcctgaccagttcattccggaacttgctgaccctgatagcacggtgatcatagctggaaccgaggctagcaagatctcctatgctgcaactatcactgccaacatgaacactgtgcaggagcttattgcagcgcatgttccagacaatatcgggatcgtcattacagctggttattatgatgttttcggaaagcgtgacgtatgggttagatctacggaaatggaccttcctagcaaaactccaatccagcttaacaagctttctgtgactgatgctaatggctctgtatggaatcttgatatttcatcaggatatatctacatcgattcaatcggagcaaaaggcgatggaactacagatgactggtatcaccttgagctctgcttcaaaaatgcagagcaaggaacaaacagaattgtaaaaggaaataagtcagcttacttcttctctaagccaatactattaaaaacaggaaggcaccttgaattcaatgcaaaatttggggttgatatcacttatggaggccagcttctttcttcaacagatgctcctagtgcaaccacaccaataggatcagggttcacatcaacattttcagacaagcaggcacagattgtggtcgcacacaaggatggccagtttgcaagatattggtcagttaaaaactgttatatcaaaaatgacagcggcacatcctcaacatttggtatttattgccctttcggcaatgcctttgatctggaacatgtctggtctataggtgggcttactggatttgatgcgagaaatatttacacgtactcttttagcgggtgctacttcgccgctccagttggaataactggcactgttggaattaatgtcacgccgattcaaaatggattgggctctggaacgtctggaacgtatgagcgcgtaggaattgtaggttataaatacagctggatattcacagagatgaactatacaactcttactagttgttatagtgaagataccagaaccagatacgccttatttcttactaggtgcaatggaataaatataaacacatatggaatagaaaacctgaccgtcgtttctggtgatggaaggcttgctgctattgccgatagccaaatttctatcaacgcactacaagcttcatataacataaacctttctggagtaagtgctataacagtaactggtaactcacaggttacaatcaacgatgtgttcattgttgcagttggttctccatatgtaccgctccaaaccgacaacacttctcgtgtgagaatgtttggatttaaatcaacaggccctacgcctcttgtcaatatcactggattgcaaactgtcatttatggtgatcaggggagaacagaatgcgctaaatttcctggaaactggaacggtggattcttgaggattggggatgtgagactatgggatgatggaacaggactacgtattaagcgtggaacagacccagcaaatgtctctgatggcacagccctataa

SEQ ID NO: 52 - DNA, 516 bp, unknown
  environmental sample
atgtctcttacacctggggttatttgtatgttcactggcggcacaattcctgatggatggctactgtgtgatggaaaaaataacacacctaatcttattgatcgttttatcttaggagcttcttcagctgacaccaacatcattagcgaaactggtatttcaggaagccatcctaaaaaatattttacaaatactactaatgggtctttaataactgcatcagtcacgattgcgccacatacattgactatcgcagaggtaccatcccatactcacaaaattgttgattatgaaggtgattatttaagaaatgctgatggtggttctcgcagcggctctgaccgctatcccgtctcaaccggaactaaacaaccagatctcaccacaacttctgtaggcggtggtggaagtcactctcacaatggtagtttaacaaaccaatcatcacactctcatggaattaatatcaacatgccttattatactttggcttttattatgtatgtaggggtttaa

SEQ ID NO: 53 - DNA, 435 bp, unknown
  environmental sample
atggagaacagacttatgaaaaaaatatcacttataataagctcgatcttactttttactttttcaaatcactcatactctacggcgctaaacccaaacaactctcttgaaaagcagtgtgagaaagaaggagggggaagttatttcattaaaaatgcccatataacgtttatgaatgctactgttatgtggaatccagaaaactcggctggagactggaaagtccacaatgccattaatattaaattgaagtataacgttgaaaattccaccaaggaagcttggttcggcgtattcggcgaaaacgtcgccagaggaagctcggcattcggtttatctagttttgctcaagccatgttcttattgaaagcaccggtagatgtttgtgttaaagggaaatatctccggggcattgagaataacactgcatcttaa

SEQ ID NO: 54 - DNA, 1320 bp, Bacillus Sp.
atgaagagcaagattatggcaggatttttaataacatcaattgttaccggggcgactattcctatcaatactctcgcaacgccaattgttcaggcagaaacaaaacaagataatatagatatttcctcggcattacgaaaaataggtgcacactcaaagttaacacaaacctttatcgatggagctttagcaagtccgaatgtacaacttgaagaagttccatctttaaatacaactcaatttctaattaaacaagatatgaaagagtggtcatccgaactttatcctaaattaattctattaaattcaaaaagtaaaggatttgtaactaaatttaatagttattatccaacattaaaaggatttatagataatggggaagataaagaaggggttacagatagactggaagtccttcaagacatgaccataacaaaccaagaaagtgtgcaacgtcaaattaatgagttaacagatctaaaactacaggtagataagaagttgaaaaatcttgatactgatgtgataaaagcacagagtgtccttaattcagagggaacaggaaaaatagataagttaaaaaatgaaatgctagatacaaaaaaatcaattcaaaatgatttacagcaaatagcgttattaccaggagctttaaatgaacaaggactaaaggtattccaagaaatttatagtctatcaaaagatatcattgaaccggctgctcaaacagcagtagtagcgtataacaaaggaaaagaaataaacaatgccattgtagacgcagagaagaaagcagagcaagaagcaaaagaaaagggaaaatcagctatagaaattgaggctgccaaaaaagaagcacgtgaaacaatagagaaaagtaaaaaaggtgaaatcgctgcagctgcagttacaaaaacgaaagagtatgatctcatgaaagtgattgatcctgaaaaaattaaaaaaacatataatacttttgctgaaattaataaactaacagcagagcaacgtgcatatttaaatgatttagagaaacaaaatcagaaattatatgacttaacgactaaattaacagtagcagatttacaaaaatcaatgattcttttcatgcaaaatgatttgcatacatttgctaaccaagtagatggagaaattgagctaatgaaacattacaaagaggatttgggtctaataaataatagtattacaaaattatcgactgaagttgatgccaataacactcagtctcaaaaagatacattaagacgattaaaaagtgtaacaactcaactcgaagaacaagtttataaattctaa

SEQ ID NO: 55 - DNA, 1230 bp, Bacillus Sp.
atgatgaaatttccatttaaggttataactttagccactttagcaacggttataactgctacgaatggtagtactattcatgcacttgcacaagaacagacagctcaggaacataaaatagaaaattatgcgttaggacctgatggattaaagaaagcgttggctgaaacaggctctcatattcttgtaatggatttgtacgcaaaaactatgattaagcaaccgaatgtaaatttatccaacattgatttaggttccggaggaggagaattaattaaaaatattcacctaaatcaggaactgtcacgaatcaatgcaaattactggttagatacagcgaagccaaacattcaaaaaacagcacgtaatattgtaaattatgatgagcaatttcaaaactattacgacacattagtagacactgtaaaaaagaaagataaggtgagcctcaaagaaggaataggggatttaatcgatacaattcatacaaattcaaatgatgttacggaagtcattaagatgttagaggcttttaaaacaaagttgtatacaaatactgtagattttaaaaataatgttggtggtccagatggacagggcggattgacagctatattagcgggaaaacaagcactagtcccacaacttcaggccgaaattgagaatttacgttctacacagaaatcacattttgataatgtattagcctggtcaattggtggtggattaggagctgctattttagttattggaacgattgcaggagcggtagtaattgttgtgacgggtggtacagctacaccagctgttgttggcggtcttacagctctaggagcagctggtatcggtttaggaacagcagctggtgtcgaggcatctaatcatatgaattcttataatgaaatttcgaataaaatcggagaattaagtatgaaagctgatctggctaatcaagcggttatttcacttactaataccaaggacactctaacatatttgtatcagacagtggaccaagcaatcatgtctctaacaagtattcagcaacaatggaataaaatgggggctaattataaagatttatatgataatatcgatcaaatgcaagaacataaactttcgttaatacctgacgatttaaaagctgctaaacaaagttggaatgacattcataaggacgcagaattcatttcaaaagacattgcttttaaacaagaaaaaacaaactaa

SEQ ID NO: 56 - DNA, 1134 bp, Bacillus Sp.
gtgaataataattttccttataaactacttgctgtatcgacgtttttaaccctgacaacaactactgtagtttcaccagtagctgcttttgcaagtgaaagtaaaatagaacaaaccagtacggaagatatatctctttctgtaaacagtgaaaagatgaaaaaagctttgcaagatgctggggtatttgcaaaatccatgaatgattactcttatttgttaattaataatccagatgttaactttgaaggaattgatattaaaggatatacaaatctacctagtcaaattgcacaagatcaaaagaatgcaagagagcatgctacaaaatgggatgcgcacataaaaaaacaacttttagatacccttacaggaattgtagagtatgataccacatttgacaattattacgatacattagtagaagcaattaatgaaggagatgcagatacattaaaagaaggcattacagatttacaaggtgagattaaacaaaaccaagcatatacacagaatttaatacaagaactagctaagttaagagatagtattggagaagatgtccgagcatttggaggtcataaagatatcttacaatcgattttaaaaaatcaagcatctggaatagatgaagatgaaaaacgcctaaatgatgttttagagcaagtaagacattttaaacaagtagaatcggatggaataataactgtatcagttccctcaattcctacatggattgctggtggtgtaatgattggggtagcaagagataatttagggacgttagagccgttattagcgcaattacgccaaacgatagactataaaataacactaaatcgtgtagttggggttgcgtataataatattgctgaaatgcaaaatgcaattggattagctattaatgctcttacttatatgtcagcacaatggcatgatttagattctcaatattcgggagtacttaatcatattgagaaagcatcccaaaaagcagatcaaaataaatttaaattcctaaaacctaatctgaatgcagggaaagatagttggaaaacattaagagcagatgcgtttacattaaaagaaggaataaaaacattaaaaatggatcctgtttcttccaaaaaatag

SEQ ID NO: 57 - DNA, 633 bp, Paenibacillus Sp.
atgtatctgatgggcattgatggaacaatgggaactggtaaaaccctttgcatgtctgttttagctcagcattttcggcaacaatctggttgtactctttatagtaactatgagttgaaacattcaaagcttataactaattttgaaatgtttttggatgttgcacagcagccttcatctattatctgtctcgatgaagctcatactgatttggatagtcgatcggttaatactaatgttgcaaaatatcttacgcatatggttttttaccttcgtaagctgcgttgcactcttatgtttacttctccagatatcgcaaacatagatattcgtcttcgtttgattatgaatgtgtattgtaaagctaagaaaaacaagaactattttaattactcgctttggaatgcacaggataataagcctttaaggtcgcttagggttaaccaaaggaaaatttttgctattggtcatcaaatctacgatactaacggaatggttgtacctatggattttcctcagactaaggaagggtatcttgatattttgaatttacttaaaaaggtttctaatcaatattatgcgcaggcatcgagcgacgcggggcaacaagccacgggagccgatgccgtataa

SEQ ID NO: 58 - DNA, 933 bp, Photorhabdus Sp.
atgttcaagaatgatattcgcgaaaaagcagttaaatttggtaaaagcaaaacttcggatcaagggttgttggacgcattacatttggaactgcctgatgtgaaagcggttatgtcagcttataagaggcagcttcctgagtttgatgattttaatagaaaaacgcaattaattctcaatgcttctaaagaatttgggcaattgaaacctgcaaagcagcgtaaattctctaaaccgggtttaaaagagagtggtgtttctggcggaaattttatttattcaaaaaaatctttgcaagatttcgctgctcatgcaggatatgtacataatgatcattatggcgatgaatttgtcaatcttaaggataataatagaaatttagccgatgaaagattatttccgggtattagcttgattaaacgcccgaaattatcaatagtaaaagatcaagaacaatggaatatgcaacaaagtgacgaggccgaagcttataagatcacggatattgaagcctttatttcagggataagagagatgtatggtgaggtaaatcctttgcatccagtaatagaatctttgatcagaaatcatattgttaataatcactatatattaccgacgatggcaggtattgctggtttgcatgcagaggtacaggcattgaataatttattgactttagaagatgaaagggcaggcaaagctattggaagtcggaaaatgggggaatatatgcgagatatattgaaatcatctatttttactcagcgattgacaacaaaacaagctggagatgattttgctgcttgtcataactgttcggggatattgtcatcgccagtgaatgtgattaccggcaaagtagaaagtgcaggaagtaatttttcatcaacattatctcgatataaaacatcacaagaatcgccaatataa

SEQ ID NO: 59 - DNA, 1080 bp, Xenorhabdus Sp.
atgattttaaaaaatgaaaatggcataacggacggtaacagtgtggtaacagcacacactgacgataaagcatcagcccagtgggttaatgtgacggatgtctgcgttaacgttgttagcgttagcggacaggcccctttgctttacgcaaatgggctgaatatgattgctgttcgcgtttatatgacctcccaagacatcaacgaaaagacaatcgatgatattgacgtcaacgaactggtaggcgctgtcacgctgattgattatgatactggggttccgtttacgaaaatagaccaccctccgtccctgaatcatattactcctggagggacatattgtacagtggcaaataaatacctttctggcagtaactttatcaatccgggaatatcaggttatggtaaaaggtatatcacactttattttgcttacaatggcacttcatcaaccagtgtcaggattggctgcaaaattaaaccgacatatcctgataagggcgctgacggaaggtacgtttataatgaggtggttaactccattaacggtgatactcactgtcccacaactcccatcaaggttaccgtaaaaaaatttaaagacagcgatgttactgagtcacacctctatagtgctaatgtctctacagggaagtcaccgaatcgtgatattttccgatattacattaagtttagtgatggtgttattacgcatgtagatcttccaacctctagccagccaggcgctccgacaggctattttcattacaaacaaacaggaaattataaggatttctgttgttttactgatgataagtttgatgtggatcccagcgcaaaatggaccacccctacatttaagattgacaactcatggtcagattctgtcactttctataaccatgaagaggacggtgtctgtattttcctctatcgtttctggtatggtgccttgtggtcttaccaggaatggaatttaggtgcaatatttacgctctatgatgagtatggtaacgcatgtaaaatatcagccatccgcgatgagcccaatgacaagattaagttctccgtagtcaattaa

SEQ ID NO: 60 - DNA, 4965 bp, Xenorhabdus Sp.
atgaacagagacaatgacagtaattttttcacccaggctggtagtttcaccagcgccatcagcggcggggtggacccgcgcactgggttgtataacctcagcatcacgctggggcatatcaacggcaataaccagatgggaccacagtttcccatcaccctcagctacagcccccagtcgcagggcaacatgggctttggtacaggagtctccctaggggtatccacctatgacacgtcttccggacgcctgtccctctccaccggagagcaatatcagacagatgaaaatacctcttccgtgacggttaagcagaaaaaactcgacaactttaaatttgaaaaacacggcggtgaatcctacagagtaacccacaaaaccggcgatgttgaaattctccgtggggaggactatggctcttccttgaagcttccggtgcggatgattaacgccgctggtcattcattatctctggcaacagataacaataaccgcctgatttctgtcagtgatgagagtagccccctcctctgggtggcgtatgatgaccgcgtaaccctgaccttttaccccggtacgcaggagaaatacagtgtaattttgcaaaccaataatgacctgttgacaaccatcacccgtcgcactaccggagaaccggacctggtgtggcatattcagtatgaggatacggggttctggggacagtgggccaccgccatgacttcaccttcgggcctgcaggataccgtcatttaccgttgtgatgggtatacccaccgtttcccggattcggccccacaatccctgcggaataaccccatgccgtacgtcacaaagcgcacactggctcccggggccgggcaacctatacaggtatcggtgtactcatactcggattacaattatctgggctatgactccggcgttgactgggaggcgacgcaggacaacctgtacaactgtctggacaattacatttattcatcagtagaaacccaaggtgtaggtatagccagtaaaactattacccgtgaatacaacagttatcatctacaggtgagtgaagaaacaagttcaggttctaattctgttttgaaaacaacggagtattacgccaaactcggaacgcccttcgaaaatcaacctgaacagtttcagttgccgagaacaatcaccacaatgtggtcagagggtagtaccgggctgaagcgtaccgaaacggttatcactgcatttaatgagtctggtaacccggtatcccaaaccgatgcggacggcacagtgacgcaatgggaatactatccggcgaatggcagcgatactgactgtccgcctgaacccaatggttttacccgttttatgaaaagcgagacggtgacgccccgcaagaccgcgtacagcacgccggcgcataaaaccgcgtatacctatgcaacatttgagcatgcaagtacagatgtcagcgccctggtgatgaaagccacggaaaagcactttgctgatgatgtgctcctgaagaccatctcctgtcagtacggcacgaaggccgcaaacaccgcaggcgtaatgacgaaaaaaacgacgacttaccccgacccgaccgacaacaagcgggagtatacgacgaccgagaccgtggatttcaccgacccgggcgtcaacgggaataatatcgatgcgtgggtttccgcttacaccctgaccagccatgacggtctcaccgtgacccgttcgagaacggtatcgtgcatgacaggacgcctgctggagagtaccgacaataaggggaacgtcacggcgtacacgtacaactcgctggggtggctgacaaagcgtgtgcacgtcaaggacacggcgtatgaacataccaccacctacgagtataccgtcgatgcgacctccggggtgttttatgccaccaccaccgacccgtccggcaacaaggtgcgccacggcttggacggcatgggacgtctgctccacataaagaaaaatgacgtggatatggacagtaaaaattccgagcctgaattcctgatgcagcagcagacccgggatgcgctggggcgcagcctgacgggaagcacccatgattatcaacaggcggccaacaaaaacaatcccacccagacggtgacgcaaacccaacggtacgacaactgggggctggtgagtgagtcagtgagctctgaaggcgtaacaacctacacggaaaccgtcctggtcctccccccgacggggacgaactgcatctggcagctccgcagctggcagtcaggtggtacggatacatccggcatcacggtcaccacgctggacgataaccacaactcggtcaaaaccgagttgtacccgaaaaatgcgcaggtcggtaaaaatacgccttacagcgtcacgtacagcgagtatgacggctggaaccagctacgcagccagactgatgagctggggcagaccaccacttataagtacgatgactgggggcgtccgaccatcaccaccctgccggacaatacgcagacgcacagggcttacgtggcgttcagctcagcgaaactccctgtctccatcagcgtgctagacagcaataacattccagtcccgggggtggggggtacgcagacgttcgacggcctggggcgactgaaaagcaccatcatcggtgggcgccacgcacgttactcgtaccagtttgcataccagcgccatccgaccgtgatttataacgaggcgggtaatcaggaggtttacacgtatatcaatgcgctgggcgaagcccctgagtccctgagggcgtcaggcgtcgacattaacgtgagtcaggactggacttataacccggtcaccgcggcaatgatgacggcgacagaagacaaggacacagaaaaccagcattccctccgctacggctatgccacgtcaggtcagcagaccagtgttaccgtggaaaaagagggcgatattaaagaaaaaagcaccaacctcatggcccgcacgattggtggaacagccaccactgtcagggactatgcaggcgggacgcagacgctcacgcttgacatactgggtcgcgccacggcgttggacgacgcagacgtcagcagcacactgacatacgacggtctggggcaggtgacgcagtggacggtgaccagcaagaaaaaccattatacgaagaccaccacgctgacgctggatgagtacggacgtgaaacgcagcgcaccatcgaaacctgggacgcccgcaacaccctgaaggacactctgacggtggtgcaggtatggagcaaaaaacaccaggtaactcaccgcaccacgacgcaaacgacagcaggaaagaccgtgaccctgcgggacgagtcttacgacttcgcccctgaacgcggctggttgatgcgctataccgtatccggcagcaccccgccgcaggatgaaaccggcaaggcgctgagcaggcaggatttcacctacgacagtgtgaccagtaacatgacaacgaagtctgtaacgtataccgacgacaccactacgttcacgatgtacctgtttgagaacaaagacgaccagtgccaactgacggggataagaactgacacgggtaccacgacatcgctgaagtacgatgacgccggccgtctgacacaggatgagtacggtcggatgttgagctacgatgcgctggggcggttgtgcaaggtgacgctcaacggcagtacactcacccgctaccggtatgatgcaggcaaccagctgtccgggcagacggtgggcgataccaccacacgttattactacgggaatagcacgctggcgtacatggaggatgacgccaccccgaaaaacgcggcactacttaccccgcacgcccaggtgcgtacgggtaaaaacgcaggaatttggctgaccagcagcgatatggcggagagtgtgctgtcggtgacagacggcaccacacaggaaaactatgcatatacaccgtacggggcgcgcaacggcgccagcagcaacgacgaagccatcgctgtcacaggctacaacggcgagcggctggacggcacgctgaatcagtaccacctaggtaatggctaccgtgcctacaatccggtactccagcgatttacctgcccagacagtttgagtccattcggggacggcggcatcaacccctatatctattgtgagggggaccctgttaatcggactgacccgacggggcacctcttcacagaaattgcgctcgctgcacgtgctgcttggaaagcgataagggattctgtgttggtgaggaaggttaccgacgcggcgggtggcatctggcataacgggaaaaccatgacggattccttgttcggaaaaagaccacccaaaaacagtctggggcgttcgtttcgggacggcgacactgcggccgggtcgaggaaggagccgcgtctgcagaaagaggtggattataaggtaacggaagcgtctagatcaccaatgtttaagtttaatgataatattagaaagaatccagaacagctgtggagtcttcatgaggataacgggaaatatatatataacagccatacaaaggtaaatggttatggtgtggagaaagcatatgtcaatttaaaaaaaatcagtaacaagcctatagatattattagtggttctcatggaggtaatttaggtgaggggaattgggttgagatatttgggccaaacgcgaagcgggagggagtaataaggaatcctagttatttggaacataaatttctcatgcaagatttggctacattgaaaaaaaataagggattgacggaccgagtttataacataaaaaatttagatcgtaatgagcttaataatatattacgcaacccgaacacgaatgttattttaggatattgctatagcgctaacgacaattatatggctagtgttgataacagaatatcttcattaatttttggctggcgttga

SEQ ID NO: 61 - DNA, 2721 bp, Xenorhabdus Sp.
atggataaatttaacagcccggtggcaaggggaacctgttattttttgatttacctgacaggcatatatccgctgaactcagcaatcgcaggcggtattacccctgacaatccgaagacacaggtacacaacaatggcaatgtgccggtagtgaatattgctgcgcccaataatgccggaatatctcacaatacttataaagaatttaatactggtattcagggcgccatattaaataacgccacccaggcggttaaatctcaactggccggtcaaatcagtgccaatgccaatctgcatggaaaagcggccgaacttatcatcaacgaagtcaccggcagcagccgttctgaactgctggggcaactggaagtggccggtcagaaagccaacgtcatgatagccaacccaaatggcattacctgtgacggatgcggatttatcaatacctcaggtgcaataataacgacgggtaaaccgcaatttgatactcagggggcactggaagccctgaaagtgacaaaaggccaaatcacgattgggggtaaagggttaaatggtcagtcaacagattatgtcgatattatcagccgggcgacagagctgaatggtaaaattcaggccaagaatcttgcatttactcagggcgctaatcagatttccttcaaagacggcacggcaaagaccattgccggagaagggaaccgtccacagttagctgtcgataccaaagcgctgggcggtatgtatgccaataaaatccgtctggttgccacggaaaatggggttggggtcaacctgaaaaatattaccagccatcagcaggatattacgctcagtgcgaatggcaaaatggaactgggcaatattaaggctaaaaccgacttaaatgccggggctaaagaaattaatatcggaccgaattctcctgttcaggcagaacgggatatcgttcttgccagcagcaaactgagtaataaaagtagtgtgactgccgggcaagatatgaggatttatggtgacactatcagcaatgcaggggcgcaagccctgctacaagccaataaaaatatgtggatccaaaaaaatgcagaagggggaaaaaacgagttagttgaaaataaatccggtaccataaaaacaaacagtggtgatttaatcatcagaactcaaaatttagttaatgaaaaagaaaatgtacaagtcactaaaacaaaccaccaaataaattctaatgctggctatggagattaccctaaattcaaatttgattttaataaacccattcttatcgatagtcgccataaagatattaaactggaacatgctgattttgtatcaaatgttgatagcaaacaggcggttattgaatcaggtcatgatgcttatttatatggagaaactttaaccaataaaaatagtagcatctctgcaaaaaataatttaatcctgacgggaacgcatttaaaaaatagtggagtttcttttgggttattagagaagtataaagaatattttcgttcggaaaatagagaaaatattttaaacagagatatcttaatatggaagaataatagtgtttcccaatcaatattaagtgctaaaaatagtttggttgctgattttaaagaatcaatatctataaaaaatgaattaccgagtgaagctaacaatatcaatcaagtaatttatggtaataattatgcagctttaaatgcaaaaaacattttgctgcatgctaaagatgtctatctttcaaatgaaataaaagcagataaggatgtgagtatcattgctgataacgcagttaaaacatcattagctgtgttaaatgctggagaaaatatatctatcgcagcgcgttatgatattaatttattagacagtaatttaaaaagtaaaaatatctccttaatcagtcatgatggtaacgtaaatgtaaaaaattctctaagagctttttatccagataatactcgcttattgagtaaattagatgcttctgccgatttaagtatttcaaccggaaaagatatttatattaaagatacattgtttgtatctaaaagtaaaaatatcgcattcaatgcaaataaagatattaccattgagcacactgatgatttattaaatcaccataacccaattcaacaactgtcaactgaccaggaagcaaaattatttgatagtttatcccctactgcaaaattagattcatcaggatctattttaatcaacagtggtggaaacctgtccttaaacagagtcaatttagacgctgacaaagatattgacctatatgctggctacaatttcaatcaatattcaaaagaatttgaaccaaaccatttcagtgtttccacggtcactaaagcacttaaacttcaaactcatatcagatccggaaacaatctattaattaatgcacaacatgatatcaccttagaaggttcagatatttcaacccaaggttcaacaaatctattagccggaaattcaataaacttattaggcattccctatttttttgagaataatggggtagaagtcttaaaatatgcactccccgttattgctataccaccgaataaaaatattattacaaccattaaagccaataaagatattaatctaatatctggtgcgtattaccatccaagcagatcacccaataacatccatcaagatcacctaatacccttcaacgagatcgctcaataa

SEQ ID NO: 62 - DNA, 1467 bp, unknown
  environmental sample
atgatgtcaaccgatcaacaatctgcactgcaaggccagccgttaaatggagcttccgaacctatcatttctgcgcagtttaagtatgagatcgattacaataacgccgcccgggtcgtcattactacagggctcgaccaaataccgatggtaggatttgtattaggcgcgttggtcgaaattttttggccttcctcgcaacaggatgtatggtcggagatcgaggcgaaggtagaacaacttgtagatgcgaaaatcagcgaattggtatatcaacaagtccaagaaagccttgcggggttgcataacaatttaaacgagtatttgtgggccgtgaaaaatacaaaggaccccaattacataacgcaaaaattcaacattgcccacggccactttattcaggaacttccgcattttcaatccaaagggtacgagctgcttctgcttccgctattcgcgcaatttgcgaacttacatttaagccttcttcgcgacggggtcatatatggcgcctcctggggatggggtgaagatgtacagcgtcatctgcgcgagcaaatcgttgaaaccattcagcagtatgtgcaatacacggatacgacgtatacggaaggtctacagaacacccaatcgaaagctcccagcaacagccattataccgaaccgttcaatactgtaaaccaatacatccgggaaatgaccttgaccgtcctggactttaaaacaatgtggccgtattacgacccaacccagtaccctaaccccgtaaaaatttacctggatcgggaaatttattccgatgccgtaggaacggcagataacagcggccccattacgctcccttctcctcctacgaaagcaatcacgaagattgaagtatgggcttgggatcgaatcgatgggtgtcaggttacgtatgagcaaggaggcgggccgaacggtgtgactcagacccctcgaatgggagaccaaggcggcggaagctccagtccaccgcatggcggcgtgttcgacttggtgacccgcggaccagttgtcggagtcaagacgctttcgggcagtatcttgaatgcatggtggtttacctttgacgatggctctaccagcaatcagctgggaggcaattatccaggcggtagcgatcacagtttcagttaccctgacgagatcttgtccagcataaaaataatgggtgtcagtaattattacaaaagtgcggattgcgctgtgttcggatttaaattcaagcaagaacaatccttgccggaacccgcactgttacgtacgatgtacgtggcgtctcccgcaaagattagtccggaagaactggcacgttgtgttggtgccgaagatatcgataaaaccggaaaactcattcaggaatggtctgatttctatcattgggatactatacgtcaaagtcattgggacaggatccaaaccgtggttgactcacaaggtaaataa

SEQ ID NO: 63 - DNA, 1521 bp, unknown
  environmental sample
atgataataaaaaataagatggtaaaaagacttataagtacttttttaatgtcattattgcttgcatcaatgatgttagtaattggagctggaaaggtttatgctcaaggttcagtttcgagtacgagtctacaggtctctgccgatagttctgattactatatcataggttctgacttttataatcacttcgttaggcctacaaccgttgacttagcgaaaaataaagttgtttataataaacagatactaacagtatataatggcagaatagataaatggaaaatgtctttcttgaatcaggattcatcaggaaaatcctggttcaaatttttatcttatccagaagcaactaaaggagacataaaaattacttatacaacggatgggattaactattctgatagtaaaccaagtctagaacagctcaaaggctacatggtcgagcttcttaaaccaattgtatatccagatgatgcaaataaccaagagaatgatatagaggtttcttttcaactttctcctgatactgattacatattgagcaattccaatttaaataaacagtttattccttttagcggagagtactggttacaaaattatagtccttatcccttttttactgatcgaaatcaactccaattcgtatacccagattattctaaaggagtaatggtgaagtatgttgatgaggaaggaaatgaaattcatgatccacaaactattagtggttcaaaaggagatgtttatgacgccagtacagatcagtacaaattggtcttagatggttacacattagacacatctaaactaccacaaaatagtataggaaattttaaagaagcgcttcaaacagtcacttatgtttattctaaaaatccagtggttgcagctgatgtgacagtaagatatgtagatatagagaataatcctatttcagaagatatcattttacaaggaaatattggtgaaaactattatactgataaaaaaaatattaaagattatactctaaaagaagttcaaggaaattcatcaggtcagttttcagaaaaggcacaaacagttacttatatatacaaaaaaaatgagttacctattgctacaggaaaagttgttgtaaaatatatagatacagatggaaaatcaattttaaaagatgttgttagaactggaactgttggggaagattatataactgaagaaaaaaatatttctggttatacttttcaaggaattcgaggtaattcaaaaggtaaatatacggataaaattcagaccataacttatgtttatactaaaaatcatattataaaaccaaaagatgaattagtaaattctggaacaaaaataataaataaaactaatccaaaagttaaaaactccagttctgaaaaatcccaaaaactacctgaaactggtgaaaacaaaaaaaggagtatattgtttttcattagtggactcactcttataactttagggtcaactattatagtatttcgacataaaaaagaataa

SEQ ID NO: 64 - DNA, 288 bp, unknown
  environmental sample
atgcgttatgacgattatcatgaggcgtgggaaatgaatccgcgcaaactttcaacagaggagattgagaacccgggaaaagtgattgaagatttcttcagggtttcgcatttaccgggcatgcgttcttctttatgggaattgatgaaaacgatggtaacgggtacattttcgaaccttaaaagccgtgaacgggccaggctgatctatttttatgagcaggtagagaaactcatagaagcagctcatgtgcttcacgaaaaaaacaaggggttatcgccgtcttag

SEQ ID NO: 65 - DNA, 4146 bp, unknown
  environmental sample
atgccatacaataacgccagttcaggatttggtcgcagttctttagttcaatccatcttagatatctatttagctgttgaacaaacagagcgttggaaacaagcggttaaaaccgtaggtcaggagaagaaacttgactccaactggatgccggtgattcaaaatgtgaagtccattggaggaggaaaatacagcgtacagttcatcaataagcaaaatccagataacaaccctcagtggattgaaactaacgatgcaacttttgataacttcaaagtttttttcaacgatcaagccaaggatttgggggcattttttcaggttgattctgtaactggtacggttagcactcaaatagaaggcggtactgtatctgctggggttgggattggttctaataaagcggatttagtcaaggcggttgttgaatgggtttcaagcggagaattatatgataaatctggtaaccccgacttagacacggcagtgggagttcagagctatttgaacttggcacaatacggacatggtatagcaacagaagcagctgaagtcataagtgcgattcgtcctgccctgagtaatgggggtgctgtggctagggaagtgtccgaaagcttagtctctactgtggtgaaaactactgccacagaaggcttgggcattgcgatgaacattgtgaacgttgtgttagatggcattgtgcttgccaatacttcatctagtgtggaacgtgcttcagttaccacaactttggtgtttgatgttgtaggaaccgcctcttctctgctcgctctgggattagggattgctggagcttccacagcagcttcaatcttgggagcgatcgccctaccaattgctggtttagcagcgggaatccccaccctagtggcactgtacgcacaaagaagcgaaaatgccaggaaggcagccgaaccctttggcatcatagctgacggctataaggccaatgccgatggcacaaggggtatgatttaccaagctgccgatcaatatcaaaaaattccttcagctttaaaacccaagggaggcgcagttattactgaaatcgacctcgttaacaagaagctgaaatttggtagccaatatctatatcaagttaatccagaccacaaaggagctggacacaccaaagttaataaccgtgatagtttttttgctgggccagatataggtcgggcaagtgctaaggccaaacagctaccgcgtctcagtatccggcaaggattgggttgtcctgagacaatggatttaaagtatagcgatgtcgaggtaattgtattacccagagatatcgagatgacctttgactatgaacacgccatagtagcaccactttggcaagaaaacgaaagcagccctggcattaatgctctgcgccagatagaatctcatcctgatatttacgagaagttttactatgattactgggcaacgtcagactacgccatcagtcaattttacccagagtacaaagccacaacagtgacggtgaagctagacaaagctaagcgaagcgttgttattccccaagttgctgacatcgaaaggtctaatttaacttatcgattgcaaggtaatggtgggacttatatagtagccttgagcgagcaggaaattgatattcgcattcaagcttcggacaatccggatgaacgctggatttttaatatcgatgccattggattgcggacatattccacttggcttcgttacccagattgttggacggttactttccatgatgatggtttcaccattggacaaacaagaacagaagataaatcattacaaattactgccgctcaaccacagcgagtgaaatttgaaggcaaaatgcccaattatgttgttctatctgacaatattggtcatatttttattgtcaatctgaaagaacgcaacatgtccttgatgctcaacattaccaaaatacaacaaaccgactccaataagatcggtagcatggacatgaactcagacagtttgttatatcgtgcctatgttagttatcgatatctgaagcaggccgctcaatcgggtaatgctaatgctcaggtggaaacggggattttaaaatcagtacctttaacaaatgctgacaacattgccatcgtttttgaagagccagattccagactacactatatgggaatttgcgatctgaagaactttgctttagttgctcactgcaaggatcagactagagataatccacctcagactatcacacagatgcaggtggataggtatggtgagctttctacaatgcgcgatcgcgatcgacctgataaattagctttcaaaggatcgtttgagaacgtatggactgccaataacgagatattctttacccaaaaaattccccagcaggagtcaggaacaaatagcgttattcaatactgtatgtacaggggcgagggcttctgtttcatcgatgccattaatgccaatgcaaggctgatggatcagattttagcagtaccactttcagagctaagaacgtctaaagtcgatcgcctgttagaccaagcagggttgattctgcaaatgcaaccacgccctgaagttaaccgtgttgactacgtttatggcaaggatacttatacgattgttgggcaaaacagtcagggtgtaagctaccaaataaaagtacacaaggacgcggaaccctcactttcctgggaagagggagaaattcagtatcagattttgtcaggatacgctttgcaattgactggaacttcagcgaataacacgatcgcactcacgcctctaagtaaataccctaacctgaaacgagcaattttgttcggacaagaaggcactgacacatactatgtggatcgagcaatattgcattatcaagccatctttgtgttgaattatgcaaaggataccaatcaagatgtcctgagactgagaggattcagaacaagcgacttcagctatatccaacagggggaagacattattctcacccataaacaaagtggaaactggctcaatcttgtcggagtgtccagcagcaatccaacggcaaatcgttatcaacacctccagttgcagtttgacgatgttacctttgcagttacggaagtagccagtcgtttatcgcttggaactgccgatgttaccactatcttcatgaatttggaggatattacctttgagaagcaagaagataacttgattgtgtcgcaaaacaataaaaccgattccaccgcttacagcaacttctatacaacctacacttctttgaatggattccaagtgaagttcccttccaccaccacagggaacatgctcagcttaaacgcccaagaacttgctgcactaggtaagtataacgtcaagggtcaaaccgttgtgactgccggaagcgccaagcagtttgtagatcggatgctggcggaaataggcaatgtaactatatatgaagtcagttctggtaatgtgtcgcgccaggggcaagacttggtgattaatgggcaagtgtgcaataagttttttgaacgtcctactcaatctcgacaaatcaagattccctatctattaaacgatggagcctttatccaagctgggtacgatttggtgtttatgcgtgttaaatacgaccacaactggggtatggatctgtggacatacacaggtgaaacttctccagcctgtcgcttgtcgtatttctacgatagttacatcgaaccaaacccaaatcaaggatatgtcacaggtcgtttagttcagaccttcacagaactaaacaataatccataccgatggggcaccacacaccagttacaggtggagaaaggtaatctcaacaatcttttagagcaaatgagcgtgcaaatacccacgcaagatggaaagactgtgattttgagttatgatgctctaaaaaagctaggccaagagtcagctaaggttctagctagttccacgagttacgaccagcggagcaataccttcacatttggtagctatagcaatactgacgcactcatcggctttaggatttcgctctattttgatcctcagaccaatgaggtagttgccgacaagcaggtagataaatatacgcgtaactcttatttaagagttcctgcggtgattatctaa

SEQ ID NO: 66 - DNA, 879 bp, unknown
  environmental sample
atgactgtagctggcgatcgcttgacaaattttcctgactctgaatgggtcggacaacgtgagagtatcagttggcagtggcagagcagggaaggcttgccatatctgacttgcagcttgctcgaccggtggtctcacggcttttttactcgcgatttctcgccccgcggaccgatcgatctgacggaagttctcgcacctggagctaaggtttaccgactccaacaggtacacggcaatgcggtactcaaaaccactgagttgtccccggttgtggctccggactcggaaaccgctgccccaagctatgctgaggctgatggcttggttgccggtcgagaattggaggcgctgtgggtttgctcggccgactgcgtaccggtgttgattgctgacgatcgcaccggactggttgctgcagttcacgcgggttggcgcgggactgctgctaagatattaccagaggcgatcgctcaacttgtggcacaaggcagtcaactagaaaatctgaagattgctatggggccggcgatcgctggaaaggtttaccaggtatctgtggaagtagcagcggaactgggagccaccattgctcctaagagtgccgttagtgcgacagccgacggcatctgcgagtttttgcaccaactcccggaaacgcctgtcttggccgatccagaaccgggaaaggtacgctttgatgttcgcctctgcaatgctctgcaattgcagcagttgggaatcgatctttctcaagtggcgatcgctcctttctgtacttattctgactcggctcgctttttttcctaccgccgcgatcgacttaaaaaagtccagtggtcgggaattgtgagcgccggcgggacaagttccttatga

SEQ ID NO: 67 - DNA, 1392 bp, unknown
  environmental sample
atgcagccatggagcccgaccccccatacggtcaatctgtcgggcatgagtgaagagtactacttcatcatttcgaaggcgcacgacccgagcggccagcccctcgtgctcagcgccaacagcgacgcccacaacacgcgcgtcatcgtggccgtgcagtcctatcaggacgacaagcaattgtgggccaagcggctgcgcagctccggcgacaccaacaccttcgccctcgtcaacaaggcccggggcaccatcctggcccgcgagagcgcgaacaacggcgccgcgatcgtgctcgtatcgatcggcaacatccagaccaacgacctcgccgtctggcaacacgacaacgtcgccgaccagtacaacgccctctgctcggtcgagaactgggagcagaagctgaacatccccggcaacgggccctatcgcgccgggaccggcgtcatctcccactggtgggaccgcggctcgatcaacgagctgttccggttcttctcggccagccgcgccctcaagctcaagcgcatcgtctgggacatgcacaacggctcgttcgaggagctgacccccgtcgtcgccctccagaagaccctgcacaacaactccaacgccgagcagcagacgacgctcgagtactcgggcgagaagtcgaagaccaccaagtacggggtcgagcacggggtcgaggtcggcctcagcttcacgatctccgccgaggtcccctcggtcgccaagatgtcgctcacgctctcgaccaaatacaatcacaaggtcaccttcaacaaggaggagaccgagaaggagacgatcaagctcagcttcccggtcaaggtcgccaagaacacccagatgaccgccaaggtcatcatgctccacgccaagatggacatccccttcaacgccgtgttcgacatggcgttcgaggacggcaccagcgtcgaggtcgtcgaacccggcgtcttcagcgaggtctcctgctacgatatcatcgcatcgtacgacgagagcacgacgaccaccggcggcggcatcgccccggtgggccaggacaactggcgctggtgtcgcaaatgccagggcctcttcttcgccggccatgcccacgcctgccccgccggcgacgaccacgaccccaaaggcagcagcaactacgtgctccaatccaccgccaacaccaaggagggccaggacaattggcgctggtgtcgcaaatgcggcggtatgttcttcgcgggcaacggcgaacccgcaggcaaacaattcggctgggcctggtgcagcaaatgtcagggtctccacttcaccggcagcggcgcaggtgtatgcccggccggcggcggccacctccacgccggcagcagcgactacggcctgaagttcctgagctga

SEQ ID NO: 68 - DNA, 3732 bp, unknown
  environmental sample
atggccaaggtgtttcacctcgactccgtttctcacgacactggcgtagttattaccgatctaggcttgcaggccaatgaacatgacgtcgagacgctcgacttccgggccggcgatgaaacgccgatcgacccgcaacacagacaaagacaggcccaactcgaagttgtagataaactttatggcccgctacacatcggctccgtgacagtgacccgttcagccttggacgccttgggtgcaatcaccgatggacagcctctgaatggtgacaatacttttttccgcagcccccatcgcgttttcgtggacaccttgcagttcaacccggttgatatccaagcctgtataaaccgcaccgttgacgcgaacgactatcggctgccaacgctactgttcgaaatcgccagccagcgcccacccaccgcgcgccctttgttgcgggagattccagatataccggctgaacccggcgattatcgaggctcgcttgaaaggcttttaaacgccgctcaaaaactgaatacctctgtgctcacacaacgaaccttgagttgggtgaataaaaccaagagtaatctcctcatcccaacgggcctcggactccaggccttcggcatctacagcggcttacgcggcttgcaagacgccatccggaacaaggacacctatcagaccgccttcaacggggccagcgtaacggccgagctggcttcaattggcctcgaggccgcgataaccaggcaagccatgcagatgctcaaggccggccagagcgccctcgggagtttcgccaagacctcattcgccttgaggctagggcgcgcaagtggcttgatcgccagcgtgctgacgcttcccttcgatatcatcgccgccgttgattcgctcaaggccgccgccaatggccgtgacgccacggaccattacgtcaacgcggcattgagtatgaccagcgcggccatgaccgtgaccatcggcgtagcggcgctggcagggtttacttcagccggtccggtgggccttgccgcaggactcatcctggcggtgggttcgcagatctggggcgcgattcgtgaagtcgacgagatcgacgactacatagaactcaccgtccatgagcgcctgcgtacagggtggttcgccttctggatgatcagccctgatgacgatattcagcagcgctacaccaccgccaagaccaccgctgaacatacccggcaacttcgggccactgccttgaaattactgcaaggcacattaagagacagcaccgaagccatcgtaaacggcaagttcaatgtcgaactggaagcggtgacgtacaacacctggaattggtggaccggtgaacgataccaagcgactcgagtccgtcccacgatcaaagacagcgacgacactattgacgcgcgcgacggtgtcactgtcgatacgcccggtgcagtccttggcacctcggcggaacacaagggtatccattggcatatcggtggaggaaacgacaccatctcgggcgttgaaaaaaaaccgaacgtcttccattacggcgcaggcgttaaaaaactgactggaggtgagaaagatgatgttttcattttcgaaggttcgccgcagacgctccgcacaaacccgcccttgccacccaatcggttagtgggcggaaaaggcaatgacacgattattttatccggccgaaccaaaggtccccaggaacaactcggctaccacgtcgatctggaagccgggcacctgtccatcatcattcaagagcaagcgaaggtgcactatccccatgcagtcctggaaagcatcgagcatgtagagatacaggagggcaggaccaacgtcatcaggggcaccgccggctcgaacatcattaaatcccgcggcaatgattcaatcgaggccggggcaggcgatgaccagattttccttctaggtgccgacaaccgcgacgcagacggtgggccgggcaatgatgtctatgccatcgcccataaaccgggcagcgtatcgatcagcgaggacggcatcgacaatagcgtgattgccctggactggagggccgacctgatcgaaggctggaagatcgaaggggacaacctcgtcgtgacctcgggctttgacgcagatgactggcaactgcgggaagtgatcatcaagaaggcctaccgacccgtcgacaacaagcggcacattcgaaacaacaaactgaccttcgtgacaaaggatggctatcacttggtgcccgacctgcccgatacgatcgaacagagcctgcccctcgacatcgaagcggtcatcacccaacaaggaacaccgcgcagcccgattatcttgaacaaccagaaaacgcaccgggtcgcacatgacaaggacaccagttattacctgtcacgccttaccgcgtcgacgacgcttcaggtaatacaacgcagcgacttcaccaccacggtgcacctggattatgccagcgccgaactgacgcggatcgaagcccattacaatgtccaagtcacccacgacgatgatgattggaacaccgtaaagtatggggaatgcggcctgaccttatacttcggcgcgcatcaagttgccctgaagaacctggccagctccgatgagcgttacaccgcacagaatacccgcaccaagcgacgtgcattttccgccctgggttcgaaccacctcgttacgctcatcatgaatgacggtgtgtcctaccgcctcgtccaaccgacacccgactatggccttctactggacgagacattcattggccaatcgtcggtgggctggaaaagcgacgtgtcattgcccctcacggcgaccagaaagaaacatatgcatcttgccccctcggacaagagcccttattacatgcgcaatcgagccacctgtgcgcagctcacctccccctcggaacaaaccggtattgaagttttgatcggcgaaggcgcgacctacctcgtgcatctaagcccggacatgacgctacgactatccacacccggtgccctggccggggccaagccccgattgccgaatgcctcgacatgggagctcgacgccacgcacttggggacggtcgagatcaatctttctgccaacctgttgcagataggcacaacgattattcatctccccacctatgaggctgaagaccttgtcgacaagatacgggtcatcactgcccaaggcatcgtgtatgcggtcgataccttattcgaacgggtttatgtagaggcgctcgacgctcggtatttcactttccccctcgatccctcggcggcatggcccagcgaactgtccgctcttgccaccagagatttgcaagtactgaatatcgcgctcaaggatggcgctcgcggcggtctgaggtacagccttgaaacacgcaaatggaccctggagaccgataagactcgcctcatcgaaagccaggatcttcgaaaaacaaatctttgcgatcaccacctcaacttctaccgggatctggcgagcgaaggccttggtcaaaacccaccgacggacgatggcgcacttcgcgtgctgcgggaaaagtgcgtggcactggcggaaagcctcacgctgggcaattcgaaattcctctcgcaaaccctgacgctcagcctggcgttcgggatgaccgcccctcagttaagcagacttctttcgttgtatgggtccctcccaaccctgtttacaagcccccctatacatatgtag

SEQ ID NO: 69 - DNA, 1335 bp, unknown
  environmental sample
atgagctttgaactcgtcatcggcaaagtcggcggtgggaaatcgctgtatgcgatgcaccgcctcattgaggagcttctcgaggaaggccctgaggctcgccttgtggtcacaaatctcgcggtcaaggagcctgagcttaacgagtacatccagcagaaacatccaatggccaacgtgccgttgagcaaacgcctgcatgtcatcgaggatgaacagatagagcggttttatgaaatccgacgcctcaaggacggcacgccctgggaaggcggcattttctacctcctcgatgagctgcacgcgaaatttaatgcgcgcaactggatcaagattgaaactgccgtcacccattacctttcgcagcatcgcaagctcggtgacgacgtctggggcactacgcatttgccggagcacgttgaccgccagatgcgcaatctctcctatgcgttccacatgctgcggaacgattaccgcaccgtttttcggatgcccatcctcggcatcgcggtgaagcctcgttcttgctttgtccgtaagtcgtactatttcgatccgacgaagcagcgcaatccgcagccctacgaggttgctacctttcagttggatgcccaaggcatcgccaacacttatgacactgcgaagggtgtcggtatcaaagggaaaaaggccgacacggcccgcatgcagaaaaaggggctgccactgctcccgacgatgattgcggccggcattgccatttgggccgtctttcaagtgcccaaactctggatggagcgcgcctacaaggcgcatcaggaaaagcttgctgcggctgcgccttcgtcgcatcacggtacaacgcccgcgccgacgctttttgaccaaattgcgccgtcgtcccttgagtctgtgacggtcattcctgctaagcctgttgatgacacgccctggccgacgatgaaacagattgctacctggccagcgcaaaaagtctcggctgagcgcaagacttaccgtggtattgtccgctctggcaggcggcttcgagtgtacttggacgacggtcgttatttgaccgaagctgatattttgacggtcggcaaaggcgtcgtcgttactcgggacggcgctgtgttgttcgagcgcgtcctcaaaccgggtgacatcgtgcaaacgcccagggaaggctttcagggccctgcgccggtgtctgtacctcctccaagcccggcgagcccgttacagggcacgccagcggccttggcggccccggtggttattgaaggccccggcgtgcgtccggatccggcgaagccttttgccggtagcgggctcgacaaacctttcggttga

SEQ ID NO: 70 - DNA, 498 bp, unknown
  environmental sample
atgagaaaaatacaaatccttcgcgttttattatgcatcttattgtttggcactggagatgtgcatgcggatagtacggtgtccgtaaaaggagttgtgaccagtattccttgcaccataacgcaaaaaaataatgggattgtcgattttggtgatgtcctgacgacgcgtatagacggctcgtcctataagtcctaccagttagttttggatctccaatgtgacacgcctgtcaatgcagatacgatgcttaatctatctctttcaggaacagaggcccctttcggggaggggctactggcaacggataaggaagggctgggaatacagtttcgctggggagatcaaaaatacccggttaacagtgcagtatcattttcctatttaaaccacgaccattctgtatacatgagcgtcacgccagcaaaagatgattcagttgaattagagggtggcgcatttacagcaacggctacgctgaccgttgactatcaataa

SEQ ID NO: 71 - DNA, 5127 bp, unknown
  environmental sample
atgaaaaagacaaaaattctgaatagcctgatgattatcggcttggtgttaggaagtatgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaacaaccaattgagaaaaataaaaggactagtgccaggaataataatccaagcgataattttgatagtgttcaaggaaacaacggtaattactttaaaccgactactgatgcaactttactgaaaattggtgaagagcaggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagatactagtaacaatttattgatggcagaagagagcgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggatttgttttttggaaacgaaaaatgtctaagaaatcgtttgataaacagtaa

SEQ ID NO: 72 - DNA, 2511 bp, unknown
  environmental sample
atgccaactgtaccaacgtacaattcccgccagactgttgaccagggactgccagcgccacaggtcagcgttcagaccaaccccgatacgttcggtgccgggctgggtgaggtaggcaatcgaattgctggcatcttcgctcaggagcagcataaagccaacgttgcgcagacgcaggatgcggtgcttcagttccagtcatttgccgatgatcaattcaacaatactgactctggcctgtatacgaagcagggtaaaaacgctgtcggccagtcagaggctgtgctgaataatattcgcggtaaggctgatgaacttgcgcagcaggtgccggagagcatgcgccgtgatttcatgcagcagatcaatcaggcggggcagcaatacaagcggcaggccagcacctatgaaatcggccaggtccggcagtacgaggaaggccagtttaaagcccttcaggaatcaactgtcactgccgctcagggacaatacaacgacccgcaggcgttcacctccacggttaagcagggcttcaccgctattgaccagtttgcagatgcgcatggctggagcgatgaagagcgtgcaaacgctaaaaaccagctgaaagagcggtctgctgatggtgctctgtcggcggctgcgaatcagaactatatggacttcatcgccgcgaatggggagcctggcgactatgacggtgccatgcgggtgagtggcagcaccggcgacgcgcgcgggctgcgcaacaacaaccccggcaacattgaagcaggacagaacaactgggaaggacaggctggcagtgatggccggtttgccaaattcgtcacgcctgaacacgggatccgcgcgctgggtaaaaacctgctggcgtatggtgataaaggctacgatacggttaatgagatcgtcaaccgctgggcaccagcctctgatggcaataacaccacggcctatgtgaaggcgctgtgtgaacagctcagcgttaaacccgatgatcagcttaacctcagtgacctgaatgtgctgaaaaagctcagtgccgggattgtgaagcatgaaaacggcagcattccctacagcgatggtcagcttgataccgggctgcgcgcggcgctgggactgacttcactggaaagccctaaacgctatacgggtaacgtggctttcgatgcagccagcacgcaggctcaggcgtcatatctgcgccaggctaaatcactgcagaacgaggcgcgcacccagctcaaggcgcagctgacagatgtgatcagcgatgccaaagcgtcataccttaaaggcgttgagtacccgaacccgccgagccaggcacagctgatttcagcttatggctaccgcgaaggaaaccagcgatttgccgatctggaaaaccagcgtgtcgccggtcagtacatcgggtcattccgtaacatgccgagcagcagcattaccacctacgtcgctgacctgaaaacgcaactgggtaccggtgaagggttcgccggtcgcgccgatgcctttgaccatgtcgaggcggcagcgaaacaggtgattaatctcagggagtcaaacccataccaggcggcgatggacatgggcgtatataagccgattgccagtaccaacccggctgatataaccagtgagatcaagaaccgcacagcggctatagatcagcttaaatcgctgggcatcaatgcacccattctgtcgaaagaagaagcagcctcaatcagtgagcgcgtgcgtggcactaccgatgtgaaccagtcaatcagcctgctgcagtcgtttggccgcggcctgcagccacaggcattgcgtagcgttgccgcatctattgcaccagacagcgccgctacagcctattcagcgctgattctgggtacggatgacaatcagtacaacaaccgctcgccgtcaatcccttacagccagttcgtggcctataagccgacgatgaataaatatgaagtcgctaagaccatccttcagggtgatcagcttatcaacccgaccaaggcgcagaaggatgcggggatcagcgcggtcaaactgccagcagatgacaagctcaaacagacgtttgatgatgaaatcggcaacgccttttctcataacccgcaggcgcgtcagatggcctggtcaatctataaatctgcttatgccgggctggcatataccagcggtgatagcgatggcgtcaacaccaaatccgttgacagcgacatcgcagagaaagcgatccagatggcaacaggtggtgtgatcaaagggttcaatggtggtgacgttgtgatgccatttggcatggacaaaagcacgttcaaggatcgctacaccgctgccgccggtgacgcgcttaaatccgccgggcttaatccggccagccagtctaactttgtgccggtcaacgtgggcgacagccagtaccgccttgttacgggtagtggccgctgggcgaccgatcctaaaaccggcgcgccaatcaccgtgagggttcagtaa

SEQ ID NO: 73 - DNA, 1584 bp, unknown
  environmental sample
atgaataagaaaacccttatctcgtcactactaatcacccttgcttttctatttttaaatgtacaaaaggtcagcgcagctatcgattataatctttttaattacaattatccggtaagtgcctattatcctaaatcctcagataaagccaatgttatgggcagaataatcaaaataaataatgttagaaatgattattcagtttccattccaatagatgtttctcaaaattcagaaggaaagctcaactattttgggttgacaacttctacaaatgcctattttacacatgattctggaaactcaatcactaatgcaggttctctcactggtccaaatactttggttgggcccggacttcaaaatcctgtcaaattaccaattcccagtagcacgataactattgatgggcaaacttactattttaactactatgttgttcaggtggtcacagaaaaagtgattagtccaatcaatgaggttcaaggaaataattatgctctgcaacctttagacactttaccagcaaatgccaacttcgcttgggcatattattctgatagccctggtgctatcattcattataaaacggaagatggtacagaattattaacttcgccaactcttattagtgaatcaggggatactattccctcagaagtaagagatttcacgggatatactttagtatctgttcccgaagaagatagttttaaaaaagcacaattaactaacttgacctatgtttataggaaaaatccagtagctgctgctactgtaaccgttaaatatattgatacgcaaggaaattatatttcagattctatcccactttcaggtaatgtcgaccaagaatacactactgaacaaaaaattatttcgggctacacttttaaagaagttcaaggaaataaaagtggactattttcaactactcctcaaaccgttacctatatctatgctaaaaatccaatcgaaataaaagctggatcagtaactattaagtatgttgatacaaacggaaattccatttctgatgtaattacaaaatctggaaatgtagggtcttcttttgatagtgaacaaaaagttattttgggctacacttttaaagaagttcaaggaaataaaagtggactattttcaactactcctcaaaccgttacctatatctatactaaaaatccaatcgaaataaaaactgggacagtgactattaagtatgttgatacaaatggaaattccatttctgacgaaattacaaaatctggaaatgtagggtctttatacactagcgaacaaaagaaaattttaggatataatttcaaggaaattcaaggaattgcggagggacaatttacaattgaatcccaaactgtaacctacgtttatacaaagatttcacctcctacaataatcaaaacttctgtaattccacctaaaactttatcagtaaaaaccctaccaaaagaatctttacccgaaactggcaataaattttttggcttcactttactttcaggaagtcttctaattcttgttagtactaccctttatctattgaaatctagaaaatataaataa

SEQ ID NO: 74 - DNA, 1545 bp, Providencia Sp.
atgaatataaaaacctttaaatttatcgataaatattcaaatggaattgtcgttaactttgataatagaaacaaaaaaacagtcaccattagcttatttttagataatgaaaatataaaaaccatatcaactaataatgaccattatcttttcaaggtagataaatcggggaactaccacgtaaccatttcatttatagatagtaataaaaacattcaccacctaattgatagccctgctagctattacttcgcccaacagaaaaccaagcaaaatattaaaaaagaatccaaatcaaaaacaataaatcataaaatagatggaattaataaatattttttagaaattaaatctgaaataaaaagttcgcatttgattatggatatattaccaaatgaactaatgaattcaaaattaatattaatcaaatcaaatattgaatcctctgttaaacaatatgaatacctaaacctttatggggaagataattttgatcgtttacttgaactatcacaaaagattgaacaattagattatgtcagctattgctgtatttgtcctgacacgaccggctatcttccgccaaaactccctttaaatagtcaagttctagaagaagacaccagtagcaatgagataacccctaatttcacttatttacaaaaatatttagatgcaccaatgggtatgaatgtgagaaacgcatgggaaaaaaacattgatggttcgcaagccgtagtacgccatttagactttggtgtttacaaaaaccatgaagatctcaaaaattcaaatctgatcgtcgttaatagccgccctgaaacccaagattgtaatcatggtaccgcatcaacaggctgtattattgccactaaaaatgcatttggtgtaactggcattgcacacaattgtcaattttatttctatgatactgatgatctcgatcaacttactaatgatgcccagcctggtgatattgtaagcttagacattcaattttcttttggcgaaaaattacttcctgccacagctgtgcgtaattggtgggaaagaatcaaaattatggtcgacaaaggtgcaacggttatattggcagccggtaatggtgggttagatttaagtgaacccggagttatgactgatttcggtgataatggcagtatgttagttggcgcatgtaataatcagactggaagtcgtgcttatttttctaattacaatcaaaaaagttcattaattaattcatggggagattggagtgttacaaccacagggtatggctcactacaaaaataccccggtaatgaacgcaattacacaaaagattactcaggtacatctagtgcgactcctttgtgtgcaggcgcattagcattacttcaaggctatgccaaacaacatcaaattattttatctgcttggggaatgcgcgaactgataaaaaaatcgacctatacggaaggtgttaatgatgggattggctatcgcccgaatgtcaatgatttattaaaagaaattgataaactggcccaaattactgaataa

SEQ ID NO: 75 - DNA, 1659 bp, unknown
  environmental sample
atgaaaacaaaaatcaaccttttcgcattgtttgcgttctgctcttccctgtcttttggccaggacagccagcacaggatggctaatgatcaaaattcagttatctatgtatgcttttcaaaaggcatcaattctgaaaaagcagcattcagccgaaacgctgatctggaaagattttcaagagagaatcatatttcgtttaagtatgatcttgactttacggataataagcttgatgaaatggccagaaacagtaaagccatcggaaattccacagaatctgtagaaaagctgaaaagaatttacaaggctgatcttcctcttcagagcacagaaacagcagaaaaaatcatccggactctggaaaggtttccggaaatagaatatgtgtctgtcatgagtgctgaacccgttgaacctcctttagtcaatgcttttgtagctaccccggatctggaaagccttcagacttacctgaacgacaatccgggcatcaatgcaaaatatgcgtggtcaagaggaattaccggacagaatatccgtgtaagggatgtggaatatggtttttacaaaacgcatgaaatgctttccaatcaaaactctatacagcttgagcctggatattctcctaattcaggattagcgaataataattaccgtgaccacggaactgcagtggtaagtattttaggttcaattaaagataatatcggacttacaggagccgcctacagtacttctgaaataaagggctatatggaatggaccactgtgggatacaacagagcttctgcagtgagcagatctatcaacgcatctcaggccggcgatattattttatacgaaatgcagactggcggaaaagacggccagtattgccctgctgagtatgaccaggtcatctgggatctcacaaaagcagctactgattcaggaatcattatcattgccgctgcaggtaatggcaatcagaatctcgatgatccgttttatgccaactatcttgcaagaggaaacagcggggccatcatcgtaggcgccggatctcccaataccacccattcaaagctgagcttcagtacttatggaaacagagtggatgttcagggttggggaagcagtgtgctggcagcaggctacggatcttatgcgaaatatgacaatgataataacagaacctataattatttcagtggtacgagttctgctacgccggtggtatcatctgcggctattctgatccaatctttttaccgccagacaacaggacaatatttaacacctgcggcgatgaagaatcttttgatttctacaggaatcccgcagggaggaactgtaaccggccagaagataggccctcttcctaatgtgaagaatgccatacttcagctggaaagtaaatttgccacccctgttaaaaccttatctgcattagaagttaaaatttatcctaacccatccagcagcagtattgctattcaaagcaatgaaaataaaaagctggatattgaaatcattaatcttcagggacgtacagtgattaaaagttctgttttatctcatgaaaaaattgatatttcacaattgccggctggtcaatatatcattaatatcaatgaaggtcagagaagagttgtagagaaattaaccaaaatatag

SEQ ID NO: 76 - DNA, 1656 bp, Chryseobacterium Sp.
atgaaaacaaaaattcaaattttctctttgtttatgttctcctgttctctctgtcttgcacagaaaccttcaaacggagactcttatgcaaaagccaatatctatgtctgtttttcaaaaggtattgcttcagcaaaagctgcatttgcacaaaaccctgagctggaaaaattggccagggaaaacagcatgtcatttacctatgaccttggctttactgatgaaaaactttctgagatggcaagaaacagtaagctcaacggttattctcctgaatctgtcgaaaaactgaaaagaatattcaaagctgaccttccccttcaaaatgaagaatatgcccaaaggctggctcaggctcttgaaagatttcctgaagttgaatatgcatcagtaatgagcagtactcctgtagaacctccgttaatcaatgcttttgttgcaactcctgatctggaaaaccttcagacttacctgaacgacaaccccggaatcaatgccaagtatgcctggtcgagagggattaccggacaaaatataagaatccgtgatgtagaatacggtttttataaaactcacgaaatgcttgccaatcaaaactcaatacaactggaaccaggatattctccaaattccggattatcaaataataattaccgagatcacggtactgctgtagtcagtattttaggttctgtaaaagataatatcggacttacaggagcagtctacaatgcttctgaaatcaaaggatatatggagtggaccactgtaggctacaacagggccgctgcagtgagcagatccatcaatgcatcccaggccggcgatattatcctgtatgaaatgcaaaccggcggtaaagacgggcaatattgccctgcagaatatgacaaagtaatctgggatcttacaaaggcggctacagattcagggataatcattattgcagcagcaggtaatgggaaccagaacctggatgatccattctatgcttcttatatgtcaagaggaaacagcggtgctattatcgtgggagctggttcaccaaataccacacattcaaaactaagtttcagcacatacgggaaccgggtggatgtacaaggttggggaagcagtgttctggcggcaggatatggttcctatgccaaatatgataatgataacaacagaacatacaattacttcagtggaacaagctctgcaactcctacggtagcttctgccgcagtgctgattcagtcatattatcgccaaaccacaggtcagtacctgagtccggctgccatgaagaaccttttaatttctacaggaatacctcagggtggcactgttgccaatcaaaaaatcgggcctcttcccaatgtaaaaaatgccatactccaattggaaggcaaatcggcaacggctgttaaagctttaccatcattggaagtaaaaatctatcctaatccgtcccaaaatgttataacccttcaaaatgtggaaaataaaaagcttgattttgaaatcattaatatgcagggacgatctgtcatcaggggaacagcaatgccggaagaaaaaattgatctttcaagcctgttgcctggacaatatattattacgatcagtgaagggcaacgaagagttgttgaaaaactgataaagcaataa

SEQ ID NO: 77 - DNA, 1656 bp, custom Sp.
atgaaaacaaaaatcaacctattcgcattgtttgcgttctgctcttccctgtcttttggtcaggaaagccagcccaaactgaatcaggatcaaaattccatcatctatgtatgcttttcaaagggcattaattcagaaaaaactgcattcagcagaaatgctgatctggagagattttcaagagaaaataaaatttcattcaaatacgatctggattttacagacggcaaacttgatgaaatggccagaaacagcaaagccatcggaaactcttcagaatctgtagaaaaactgaaaagaatttataaggctgatctgcctcttcaaaacgaagaaaccactcagaaaatcattcacagccttgaaaggtttcctgaaatagaatatgtatctgtgatgaatgcaactcctattgaacctcctttgataaatgcttttgtagcaacacctgatctggaaagcattcagacctatctgaatgacaatccgggaatcaatgcgaaatatgcctggtcaagagggatcacgggacagaatatccgtgtaagagatgttgaatatggtttttataaaactcatgaaatgcttaccaaccaaaactccatacagcttgaaccgggatattctccgaatgcagggttagccaataataattatcgtgaccacggaactgccgtggtgagtattttaggctcaataaaagataatatcggtcttacaggagctgcttacaatacttccgaaataaaaggatatatggaatggaccactgtgggatacaacagagcttctgccgtgagcaggtctattaatgcttctcaggcaggtgatattattctatatgaaatgcagaccggaggaaaagacggccaatattgtcctgcagaatatgacaaagtaatctgggatcttacgaaagcagctactgattcaggaattattatcattgcagctgcgggtaacggaaatcagaatctggatgatccgttttatgcaacttatcttgccagaggaaatagcggtgctatcattgtaggagcaggatctcccaataccacccattcaaaattaagtttcagtacttatggaaacagagtggacgttcagggttggggaagcagcgttcttgctgcgggttatggttcttatgccaaatatgacaatgataacaacaggacttataattatttcagcggtacaagttctgcaacgccagtagtatcgtctgcagctattttaattcagtctttctatcgtcagactacaggtcagaacctgacaccgtctgcgatgaaaaaccttttaatttctacgggaattcctcagggaggtactgtaacaggtcagaaaatcgggcctcttcctaatgtaaaaaatgcgatactgcaattggaaagtaaatttgcaacccctgtaaaaacatctccgctggaggtaaaaatctaccctaatccatccagcagtagtattgcgattcaaagtacagaaaacaaaaaactggattttgaaatcatcaatcttcaggggcgtacagtaatcaaaagttctgttttgtctgatgaaaaaattgatatttcacaactgtcaacaggtcaatatatcatcaatatcaatgaaggccaaagaagagttgttgaaaaattcacaaaactttaa

SEQ ID NO: 78 - DNA, 1659 bp, custom Sp.
atgaaatcaaggatcaaccttttcgcattatttgcgttctgttctactttgtctttcggacaggacagccagcccaaaatggctaatgatcaaaattcaattatttacgtatgcttttcaaaaggcatcaattcagaaaaaacagctttcagcagaaatgcagacctggaaagattttcacgggaaaatcacatctcattcaagtatgacctggatttcacagacaacaaacttgacgaaatggccagaagcagcaaagccatcggtaattccggagaatctgtggaaaaactgaaaagaatttataaggctgatattcctcttcaaaacaaagaagcctcagaaaaaatcatccatattcttgagagatttcctgaaatagaatacgtttctgtcatgagcgccgaacctattgaaccgccattagtaaatgcttttgtagtgactcctgatctggaaagcctgcagacctacctgaatgacaatccgggaatcaatgcgaaatatgcatggtcaagaggtatcacaggacagaatatccgtgtgcgtgatgtagaatatggtttctataaaactcatgagatgctgtctaaccaaaattcaatacaacttgagcccggctattctcctaatgccggattagccaataacaattaccgtgaccacggaactgctgtggtaagtattttaggttcaataaaagataatacaggacttaccggagctgcttacagtgcttctgaaataaagggttatatggaatggactactgtgggatacaaccgggcttctgcagtgagcagatctattaatgcatctcaggcaggagatattattttatatgaaatgcagactggtggaaaagacggccagtattgccctgcggaatatgataaagtaatctgggatcttacaaaagctgctaccgattcaggaattatcatcattgcagcagcagggaatggaaaccagaacctggatgatccgttttatgcaacctatcttgcaagaggaaacagcggggctattattgtaggggcgggatctcctaatacaacccattcgaaattaagcttcagtacttttggaaacagagtggatgttcagggctggggaagcagtgtgatggcagcgggttatggatcttatgcgaaatatgacaatgacaacaacagaacttataattatttcagcggtacaagttctgcaacaccggtagtttcttctgcggctattttgatccagtctttctatcgtcaaactacaggtcaatatttaacgccttctgcaatgaaaaaccttttaatttcaactggaattcctcagggaggaacggtaactggccaaaagatcgggcctcttcctaatgtgaagaatgctattcttcagctggaaagcaaatttgcaacacctgttaaaactttatctgccttagaggttaagatttatcctaatccttccagcagttccattgctattcaaagcagtgaaaataaaaaactggatgtagagattattaatctccagggacgtactgttatcaaaagttcggttttaccgaatgagaaaattgacatttcacacctaccaactggtcaatacatgatcaacatcaatgaaggccagagaagagtggttgagaaactgacaaaactctaa

SEQ ID NO: 79 - DNA, 2175 bp, custom Sp.
atggctcccctttcgtcaaaattgaaaccaacgttctcgaatcgcttggcgctcgccgctaccattgggtctatcgccattatgccggccatacccagttacgcccaaatactcagtacggacaacttacctacattgggattgggtagcgatgcctttcaatttgacccacttccctcctctgatggtactgaacgctttctggctaaatatgggcagaatgcggcaaacttgacctctgaggaaaacaagacaaaaaacctctcggaaatggcacaggactatgctcgtcaaaaagcagctgatgttgccaccgatgaaatatctcactggctgtcaaaagctggtaatgctaggctcaatattaaccttgataaacaactgtcgattaaaaatacccaattggactggttgataccttggtatgaccaacccgatttgttactgttttcccaacacagcattcaccgaactgatggcaggctgcaaactaatcacggtatagggttacgccactttaaccaaaacagcatgatgggtctgaataccttttttgaccatgatttatcctatcatcattcccgcttaggatttggcctagaatacgcacaggattacgccaaaatcagcgctaatagctacttaaggctatcttcttggcgcagcacatcagaattaaaagatgattatgatgcgcgccctgccaatgggtgggatattcaagtcgaagggtggcttcctacttattcaaacttaggcgctaacttaaaactagagcaatattacggtgatgacgtcgctttatttggtaaaaataaacgtcagaaaaaccctatggccaccactgttggtgtgcattggacccctttcccattgctgggtattaatgcagagcataaaataggaaatggcaataccaacgaaactcgtgtaaacctcggtttaacttggctattaggcaaaaatctagcgcagcaccttgacgtttcagcagtcgatgcaactcaccgtatttccagtaaccgtcatgattttgttaatcgcaacaataatattattttggaatatcaaaataaaaacttaattttgctgtcattacctcaggttattcaaggcgtgaccggcgaagaagtgtctattattcgcaacttaatctcagagtatcctctcgaaaaaattattgttgaagcccctgagttggtagcggcaggtggtagcattacgctaaatggtctcaagagttcagtgaagttgccctcttacaaaatagaggaaaatgacgttaaaaaccaacaactcaaccgatatcgcctaacagtaaccgcttatgacattaaggggaacatgtcaccacaagctgaaaccttagttgaagtgtccaatactggcttgctcgctatcatccataaaaatggtacaaaaaagagtaatgttatagcaaatggtcgagacccaaatgtattcactgtagttattaaggatgcgcttggacataccgtcccaaatgcaaaagtgaattttaccctacccgttgggcttacctcgttcaatcaaaaaaatacaagttattattcgttatttaaccattttatgtggaaagcacaggtcgcaaaatccgcttcagaacaagagttcgccattatcgctaatagcaaaggagaagcttctattcaatttacagcttcggtatcagggagctacgccttaaaagccagtacgcaatatggtgcagaaattaacgaacagtttaactttaaacccgatattgatcagtcgtttatcggcagtatagagattatgcaaaacaatgcgttagcagatgggaacagtaaaaataaaattaaatttcatattgtgaataatagccgacaaagtatcgcaggtgcacaagtgtattttagtggtaaaaatgtcgctatttcaccgacgatacctaccgatgagcagggaaataccgaattagaaatcagtagcttaactgctggaacaacagaaatcattgccactcttaatggtgatagcagggtcataccggttaattttatagacaaaaatgccacgtatcacagtcaagaaaaccgtatcgtttataagggggccttatttaggcagcccactcataaacctgcaacccaaacagactcattgtggcatttattcggtcaattattttaa

SEQ ID NO: 80 - DNA, 3816 bp, unknown
  environmental sample
atgagccgattaaaactaagccggaaccagcatcgcgccgtcagcggcgcaaacgctgaccaataccgcacaaccgcccctgttttcggattaatgacgtccgctcacagggcggcgacaattctgttgtttatattatgtttctttttcgcaagcctcgcgcaggcggccgttaacaccggactgtccggcgacgaccgctatgccgggcgtttcccgatcgggtttgagttccagtactacgataaaacctataatcgattttacgtttcaaccaacggtcttatccagttcgctaacccgagcatcgactacgacaatacttgtctgccgggcgagttgaacaatacgctttacgtattctgggacgacctgcgcactaacgtcgacggccagccgaccggcaagatagaatatcagacgctcggcgacgcgccgaatcgccgcctggtcgttcagtggaccaaccaatactatttcggcactaatttgccgatgggcaccttccaggcaattttatacgaaggctccaatcagattaaatatcagtatcgcaatctgttggacgaacgcagccgcggcgacagcgcgaccgtcggtcttcagggccctgaaggacaattcgcgcagttcggctgtaacgaagcgaatctgctggagtccggacaagcggtaacctttacgccgtctgaagacggtctgagctatgtcgtcgacggtcaggcggaatacgactttatcgacatttccggtttcaccgtcgactatccggcgctgctgtccgcctatactaatcaggcgcccggctgggaatggaaccgcaacagcgacttaaacgcttaccaaattgatattcaaaacgccgccggcgaatctgtcctacaggaaatcgtcggtaacgtcggccagtatatttatcaggccggcgacattcacggcgcaacctggcgcgctaaagtccgcggcagcatcaataacggcgcgacctgggaaatctggtcgggactttcatcgccggttaccgtcgataaagtgaagccgagcgccgcagtcagcgaattccaccgcctgtcggccgaatcggccaggatttcttaccagacgaccgacgacttaagcggcgttaaatccattcagttgcaggtagcctccgacgccgcttttgagaacgttgtactggagacatccctgccggtcaaccgcactcaatatcaactgacgcaactgccgcaagccgcctcgctttacgcgcgcattcacgccgtcgataaagccggcaaccgttccgatgattccgccgtggtcgagctattgatcgcggcgccgtcgttgattacgccggttaacggcactcgcgtcgacgaaccgtttatcaccgtcagcggcataacctatcctgaagcgaccgttcagctgttcctcgacggtacggcgttggagacctcggttcaggccgacgaaaccggctatttcaccaccgttattgcactcggtgaagaacgaaactatcgcctcagcgctcaggcgcaaacaccgttaggcgccagttcggcaagctatgaagtgcaatttagctatcaggaagtcggcgctaccgtactgtttgcggcgccgaacgccgacgccgtgctgaccgcgccgacggaagtcactgtgatcgcttcggacagatccggtatcgataacgtcgcgctttacgtcgacgacgcgctgctggccaccctgaccgaagcgccttacagctttatgtggcagctatctgaaagcgataacggcgcccgtacgttgaaagcgatcgcgactaccggcaaaggcaaaacgtttgaggcgtcaaccaacgtaacggcggaagtgctgccgccggtcgcgccgccgacgccttataccggtaaagtcaattcagtctcgcccgccgtgtcttacggcgagccgatcgtgattgaaggccaggccgttgagcgtgcgacgtcggagctgatggcaaacacgcctttgcgcatcgtcttaatcaataacggctttaagcggactatcgcggtcagcagcgacgataacggcctgttccgttactccttcgtgccgcaatcgaccgacaaaggcacttacagcgtggcggtcattcacccgaatgaaacggaaacggtcgcccagggcaagttcacgataaaccgggttaatgtgcatatcggcggctacaatttgatcgctgcccgcaacgttccagcgaagattgacgttaaagcgacggcagattcaggttcgctgggcttttactggacgattcgcgccgaagaccagcctgacggtcaattgcctcagggcattcgcattaatagcacgccgaccaatatccccgtcggttcgactacgtcgactcacgtaacgtttaacgccgacgacagcgccgccgaaaccggtcatctgtatctggtcgcgttcgcgaatgaatccggcgatattgtccgcggcaaactgcagattaaatatcgtctgactgaggcgcaaccggcgctttatactacgccgggctttattgagaccggactggcgcaaaacagcaacattaccgaaacggtaacgctggctaatcgcggtctgactacggctcaaaacgttaacctgacgctgcaggacgaacagggttccgccgcgccgtcgtgggtgttcctggccaatgaggcggatattcaaaccgttaaggtcggcgatacggtggcggttaacgttaccgctcagcccgacgacagcgttgcggacggcatttaccgttttaacctgcatgtccgcgccgacaatcaggcttcgtttaacgtaccggtcgtcatatctgttatccaaaacggcaccggcggcgttcgctttgacgtcgcggatatctacaccgccacgcttgacgccaacggccagccgattttaggcgtcgccggcgcaacgattaagttgcagaatgaagctgctctgggaagccaacgcgcagcgacaaatcgtaacgcaataaccggcgagtatacgttgaaaacggataacaacggcttagccgccgtcgacagtttgccgccgggaatctacctttatcgggccagcgcgccgaaacatgaagatgttacgggtcgcgttcgcatccgcccgggcgtgatgaacaatgagcatattttccttaattatgaaattatcaatattgaattcagcgtaactgaaaccacgattaaagacgtttacgacgttaatctggatgtcacttttaatgctaacgtgccggcgccggtcgtcattcttgagccgcgtacaattaatctatacggcatgcaggtcggcgaagagaaaaccggtcaactgacattaactaattacggtttagtcagggcagacgatcttacatttaagttcccacagtcagacgagcgattccactatgaattcttcggcgatataccggaccaattattgccaaaaactcgtctgattatcccttataaagtcaccaaactgaaagcaagccctttcccgcgttcgcttgtaacgccgctatctaaactggcgagaagcaacaacgaaaattgttttgattacaacaacgacgcacaggcgcaatatggctatacctgcgcaaacggcgatacaagctccggctcagataacagccgattctatgaacgtaccggcgaagattgtgaaccaggcgccccctgggaagaggatgaagaaaaagaaaacgaaaacgagcctaaaccgccgtcaacgccaatgaccgacggttgttcacaagactgcgaaggctgctgttcccccggtaacggcgcaggtaatagctattaa

SEQ ID NO: 81 - DNA, 1251 bp, Yersinia Sp.
atgaataatatcacagaatataacgatacagcgaactttgtcccttataatgtatacgctacttcggcctttgaatttgactgggactcttcagctattcttaagcaagcagttcttaaaggtatatcattcattccttatgtcggtgattatttatcctctattattggtttcttttggaaagaccaagagagagatatctggcaggaaattttgggccgggtacagcaacttatcgaagagaatgtgcttaaagctattaaaggtattttattgggcgatattgctgaacttaaagggaagattgcatccgttgttgcagccttgcaggaccatcctggtacaccggaagccaaaagtttatttatgagcgtatcggtacatttggacagcgtacaacgcaagtttactacttttgatcacaaaactaattaccatatcctgccgatgtattcagcaaccgcgttgatgcaaataatgtactggaccatgggcattgagcgtaaagacgatatcggattgaacagtaatgaagttgggcaacttcaacgaaatattaatctattggttacacatgtcgaggattatgtccaagggatttacgatacagaattagagatccaatacaacgactcggcacctaatactgtagccaacaatgttatgtatgtacatggctactgtcgggtgcatggtttggagtataccgagatcattcaaagtattcagaataatggaagcaatacaaagggactgtattcaaaaatactgagctactcgactttctttggttggccaaccagtcaggcacgaattctcgcattaaaagacgaagtaaatatgccggagccatttaaaccaaaattaataaatggccgtataaaccaagttaagtcagttaaaggctatatacgacgtatcggaggtgctttacgggtaggtggattagaaatcacctttgagaatggtagtaagtactcgcaaggaactgttactggtgaatttagttcaattgaccttaatgggagtgtcattgaaacaatggaaacttggggtagtggcgcaattgacgaagctaaatttaccttaagcgatggccgtacctttactgtcggtcaacgttattcaacaaattacagaaagtttgcgcttgagggacactatatttctggcatttttattgccagcgatcgaagtgaacttgccggccaggctgcaaatatttgtgtttcttatcatcagaaacagtga

SEQ ID NO: 82 - DNA, 411 bp, Yersinia Sp.
atgagcaaggtaaccatcactattgatagcaattcaaatgaagtcgacgttaaaaattcaactgaggctgataccgaaagcctagcgttgaccgctgcacaagttagaaccagggtgccaactgaggtcgcgcctaattcaagcaccgaagttctgtatcggagtacaccgattattcctgaaagtcgtaggaatgtaatgatcactaatgatggtgctgcaaatgtcattacagcccaatactactggtcgcacagtttcacgagtcaatggttcttatatacgtctattgatgtcaatgttggtgattctaagttattagtctcaccctccaactcattgtattacagtaaggttgttctgattaataacacaagccgtaaagcatatgttactgccgaggaaaaatag

SEQ ID NO: 83 - DNA, 1413 bp, Comamonas Sp.
atgaaaaaagcaaaattcgagacatcatcagggcgcagagttttcatacaacgagccgcagctggggcatctgtcttatcaactgcggggcttgtctatgccaatgatgatttgcctatgcaagacgaagtacgtcagtctggtttggcgggggatatctatgatgttttacgagagagcattctcattggtgcgtttgcagtcccggtgatcggcggatttttgtcatttttgggtgcatcgtttatacccagctctggtgagtcaccggagcagatgtggaaccgcctgatgagagccaggatttcagatgcattgttgagattggctcagagggatctggtcggtctttctgaagtcagtcgcctctataagattgctattgaaagtggaaatagtgacgaaattagggctcaaagcatcgctgccaatacgcaatttacggcgatggttccggggtttcaagtcagaggagaggaggctgcgctgctgcctctgtttgcgatcgctgctacccttcatttggcattgctgagagatatggtgctcaaaggacgagatattggtctgagtgacgggcttgtggctagatacacaagtgaaatggttgtgctgatcagacggtataccatctatgtggatacccatgcctcgtccaccatcgataaagcgcgcagagataacccgcactctaccgtcggcttggcgcaaaacatgcctttgtccgcgatgctgatagagaaaacaaaatatcagttgacggtgcttgacctgcgagatacctgggcgaatcttgatccgattcgctatcctggtaaatctcgtattaaactcgatcgcgagatatttacgcccgtcattggctggttggggcgaaaaaatagcaggcctgatgttattccagtgtggaggcgtccatcctccccgctgagtagccttgaagtctgggatagaatgcaatggcgcacgcgttttatattcggttttgatgcgatgtatgaagatggcagtgtcatgagttccggctccagaatcagtaattcccacaatgtgcggttgggaaaatatatcaatagggttactgcggaagctgcagcaggtgtgtatcaaatgagatttcgtagcaatgatgggcgctggacgaaagtaggtagagatgctgatgatgacacgcctatcaggaggtttgatagttcttattctgggcatcggctgtcctcaattcgtcacgtgggtatcggaatgggggccgctgaaggagctgtccgtggctgcgtactcgggtttcaactgattcatcccagtggcgctcccatgtcccgcgaagccctcaacagcatggcacccaagattgcgccgcaggtgctgaagtggctggaggatgaagctattcccaaccatggtttaatatag

SEQ ID NO: 84 - DNA, 1395 bp, unknown
  environmental sample
atgtctaatccccaaatcgatactcatggcccgcgcgcgcccaacccgtttcatggccatgtcttccaacccgcatcccgatcgtacttcgcctatgagaatggacagctcgacgtcggtgcattgaaccaacgtgaatcaggaaagttcttcccggcatcaaatgccggtctgagagattcattcgcgcctgacgatcaggcgaatgctcggccacctgccgacggaaagattgcgagtgcagagcagctaacaggtcagtttctcgatgagccaggaacgcactggaccaagcataaagtcggttcaaagaaaacgcttgatgtctcatggtactttgctgtggcacatgtgacgcgccggtggaactatttcatcacgaagcccgactgggatccatcacttccgcttagccgtgaccagtttgaggaaaagccgttctacgtagttcagattaatctggagccgttctggtcccactccagcgcaatgaagccttctaacccgaccgtacaccaggtgcctctgccagagcgaacaggttatcatgttcttttggctgtctgggaggtggcagacacaggtaacgcattttatcaggtcgtcgatctggagtttgcagcgaccgaaactcccgttgtcggtccctccacgccggaaaacctcgcagctagcgagattaaagaaaagtcggtcaaactcatctgggatcgttccgaaggcaatgccgatgttgctaagtactgcataacccgcaacggtatcacgacaattgacgtcgcagtcccgaatcttgaatggaccgattacagtgtttcccccgacactcggtatacctattttgtccatgcagttgacgtcatggggggggtatctgcgccaagtcgagctatcattgtaaataccttaccagaagggggcatcaacgccccgccgacggcgcccgggctcctgcatagtatgaaagaaactaagaactgcgtgagcctgatgtggagtgcatcgaatagcgcagttggcgtagcaaagtacgtggtctatcgcgaagggagcgagatcgctcgaatttccggcaaccaaacgacttatgatgatgcaacacttgcatctgatacacagtaccgattctttgtagccgcactggatcgaaacgacaggctctcggtaccaagtaatgtactcacagtccgcactaagccggacgtgggcgatgattatccggcttggaaactctccggagcatataaagccaaggatatcatccggcacaatggacaaatttgggtgtgtttacaatcgcacattgcttacgcggaagcgtgggctccaggtgcatcggatagcatgacactctggcaagcatacgctggaaatattaagcaacactgtttataa

SEQ ID NO: 85 - DNA, 1368 bp, unknown
  environmental sample
atgcgtccccacaagcccgtcgcactcctgtgcgcctcggccgccgtcgcgatcggcgccaccgtcctcatcccctccgccgcgttcgcacacgggttcgtcggcgacgactcgggcaacccgacccacacgctgaccgctcgcgccgcactcaaggccaacggcgacatgggcggcgcgcagtgggagccgcagagcctcgaggctccgaagggcttccccgcctccggccccgccgacgggcacctcgcctccgccggccacgagcagtggtcggcgctcgacgaacagcgcgaggaccgctggcagaagaacgtcgtcgaacagggcgacgtcaccgtcgactggacgttcaccgcgccgcacatgacgtcgcagtggcgctacttcatgaccaaggagggctgggacccgaacgacgcgctcgaccgcgacgacctcgagctcatcgagaccgtctcgcacgacggctccgccgcgtcgaacaacccgtcccacgagatcacgatcccgtcggaccgcgagggctaccacgtcatctacgcggtctgggacgtcgcggacaccgcgaacgcgttctacaacgtcatcgacgtcgacgtgcagcccgccgacggcgagaccccggagcccggcgaggacaccgaggcccccggcctggtgccggacgccgccgtccgcgcggtcagctccaccgaggccgagatcacctggggtgccgggtccgacgaccgcggtgtcgcccgctaccaggtcgtccagctcgggtccacgcaggacgagttccgcgtcctcgaggaacacgccgcgaccgcacgatcgacgcggctgacggggctgcagccgggtgcgctctacagcttcggcgtccgcgcggtcgacgcagcgggcaacatcggcgtcgcgcactcgatcctgaccgtccggatgccggagcaggccgcagcgccggcagcgccgaagcacctccacgacatgggcacgacggagtccaccgtcgcgctcatgtggaccgccggggacgacaccgcgggcgtccgctacgaggtgttccgcgacggcgagcgggtcggcgagacgggcgcgacgaacttcgtcgacgtcggcctccgggccggctcgcggcacgagtacaccgtccgggccgtcaacctcgacgggatcgcctcggcggcgtcgaacacgcacgtcgcgaccacgaagggcgacgcgggctcggagtacccgagttgggacgcgcacggcgcgtacacgaagggcgaccgcgtgacgcaccagggcagcacctacgaggccgtgcagtcccaccagggccacggcgacccgaactggatcaccgcgctgtcgctctggcggccgctcggctga

SEQ ID NO: 86 - DNA, 1338 bp, unknown
  environmental sample
atgcctggtaaaaatatttctccacgtcatgggcgggtaaccacccctgaatcgcgtgcagtgttggcgcggcagaggggtctgttgcctgatgattcggtccccaactcattggaggccggcaagttcttcccgctgtatgcgggtggcctgcttgacccggttgccccagcggatagcccgagcggcacgccccctgcggatggcaagatcgccagtgcaggttatgctgccggagccattcttgatgagcctcgcagcgactggcaaaagcacgaggtgcgctcaggagacaagttgacagtggcttgggcctatcacgcagtccacactacgcgccgctggaattattttattactcatcaggattggaacccggccgaacccctcaaacgcgggcatttcgaggcgtcacctttttacaaggtcgagttctccctcgaccctaattgggagcacactgccgcgctgacgccgtccgatccgacggtgcacgaactgatattgccccgccgcgaaggctatcaggtgctgttggccgtctgggaagtcgccaacaccggcgccgcgttctatcaggtcatcgacctgcagtttgccggcgccagcgaaggtcaggccccgaccgctccacaagggctcagcgccagcagcgtgtccaaatcaaccatcggcttgagctggttggcttcagcggcgagcagtggtagccatatcgagaaatatacaatttaccgcgatggtttgggttatgtggtcgtgcgtgatctcgacgaactggagtatctggatacgctgctccaggcggatactacctatacttactttgtttcagcgaccgataacttgggccgagaatctttgccaagtacccaggttactgtcagaacctggggtgccggtggcgaaattcctgcgccgactgcgccagcgaacttgcacgagatgggacggactgaaacatctatcaccctcatgtggactggttcagtgagcaccagagggctgttgtatctggtgtatcgcgatgcggtcgaagtcgcacgtctgccccagcgtacgctggagtttactgaccatggcctggcacccggaaacacttacaagtatgtggtcaaggcgatcgatacagccgggctctattcgcccgccagtaacgagttgaccgctaccacgcagggagtcccgcaagtaccgcaatggagtgctggggcggtcttgtacgaggtcggtgatcgggtcagtcatcagggcggcgtgtactcgtgtattcagcgccatgtgtccaattcaggttggtcaccgacagcggcgattaccttgtggcaacccgcctga

SEQ ID NO: 87 - DNA, 1359 bp, custom Sp.
atggcaaagcacatcacgaaccctatcagtcaaaacataactccacgtcacggtcatattttttctcccgcctctcgtgcctactttgcttggcaggcaggtgacttggatgagggggcactcaaccagcgtgagtcgggcaagtttttccccgccgttgctggaggattgctggacgtgtatgcccctgaagatgtggccaattcgccgccgccgccggacggaaaaattgccagtgccagtcaggcgaccggcctgtttctcgatcagcccggtagccactggcaaaaacatgaggtgcggggaggcgaggtgctggatatttcatggcactttacagctaaccatgtaacccgccgctggaactacttcatcactaaagaggcttgggacccgagccaggtactgtcccgtgatcagttcgaggcggagcctttttacaccgtccagattaatctgaaaccttactggtctcatggtaatgcgatgaagccgccttcacccaccgttcatcaaatgccactgccaatccgtgagggataccatgtgttgctggcggtttgggaggttgcggataccgccgcagcattctatcaggtagtagatcttgattttgtaggacgggagggcggcggtgggcggccaaccacgccaacctgcctaaaagccagtagcatcaccgataaacaggttcagttaacctggaacgcttcaatcagctcttctactgtcgcgttgtaccgtattacccgtgatggctccacgacggtagatgtctatgttccgttgctgagctggactgataacagcgtattaccggggaccagctatagttattttgtgaccgctattgatgatagaggcaaccagtcacttccaagtatggcgattcaggttagaactcaagctgaaggtggtggtacggcccctccaacggcaccggtcaacctgcactctatgaataccacctcaaatacggtgtcattgatgtggggagcatcgacaggcggctatccgctgaagcattataatttttaccgcgatgggaagcaggttacgacgatccccgcttcacaaaccagctataccgacagcggcctgactcccgcaacaatgtaccgtttttttgtggccgccgaagatactcatgggcagctgtcggtgcctagcaacgtgctaagtgtcactacctctatcggtgaagggggcgagacaccggagtggaagctaggtgagtcctacagggtgggcgataaagtcatctatcagggggttaagtacgcgtgtttccaggcacatatctctaacgcgggctggacgcctgcagagacagtaaatgttctttggttgctggtttag

SEQ ID NO: 88 - DNA, 1371 bp, custom Sp.
atgaaaaacattatttctaaacccaaagagggtctgtcttcccgccatgggcatgttttttcgccaaagtcacgcgcctatttcgcctgggaaaagggacaaattgacgatggtatgttgaatcagcgtgaggctgggaagttttttcctgcaaagttgagcggtctggccgatccggttgcaccgacggatgtttatagtgcgcttccgccgcgcgacggggaaattgccagtgctaatcagggaaacgcaagatttcttgaccagccaggctcagactggcccaagcacgatgtgatttccagtcagctgctacctgttcgctggcattactctgctgttcatgtcactcgtcgctggaattactttattacccgtaaagactggaaccctgatttacctttaagtcgcgagcaatttgatgaaaagcctttttttagcgttgaattaaccgaacagcccttctggagtcatggtgacgccctgacgccgcctaatccgaccgaacatatgctgatgttgcctgaacgacgcggttatcatgtattactggcggtgtgggaaatcgcaaataccggaaatgcgttttatcaggtcattgatttaaatttcaccgacagcacgatttcgcttccacctcccgcggcaccagaagccttacgggttaagggcgtaacgggtaataccatttcacttacctggagtgccccgtcggtagcggcagcttattacactatctatcgtgacggagtattcgctgaccgcgtaaaagcgatggaatttactgattcagggctgaaagaagatacggaatatacctatgaagtcaccagcgtcgatatgtccggaacggaatctgctcgcagtcatgctttaactgtacggacccagtccagcgccgctattgatcatccaccttctgcacctgaaaacttacactgtatgcaggttaccaccaacagtattagcttgatgtggagtccgtcgcagagtccggtcgctattcagtgctatatccttcaccgggatggtcaagtcattgcgcgtacgcctgccagtcagttgacatatgttgacagcaatcttcaggaaggtacgacatatcactattatgtcgttgcacaaaatgaaaacggatgcttatccgcgcccggtaatcaacttgccatgactactgagcgaacatcaacgacaacccccgatccggcgccacatcgtaaatgggctttacgctctacatttagcgcgggcgaaattgtttctcacaatggcagcttatggcagtgtattcagacacacgtagcgtattcacccgaatgggcgcccggagcttctgattccgccacgctatggcgcctgatcaaagcgtaa

SEQ ID NO: 89 - DNA, 1956 bp, Arsenophonus Sp.
atgaatataaaaaaatatgccgataatagtaaaataatacatgtcaatcataactttatgcaagataaccaaagctccttaattagaacttttgttattgaagaagttaatgttcaatttataagattagtgtttagtttggctaatatgccatctggttcatacatagaaattactgatcgtaagagacaacatacacgtatctttccactaaataatggcgctacactggatgtaactttttataataattgtatcgatatcaaagttattttacccaaaaattatcactataataaaaatcaaatagcagagcttacttattatgaagcccttccccaagatctaacgcaaattgttgaagatagtcatgatgggcggcaaccttacatgtggtataaaaatacacctttttttaatccagttcgcgctgtccattttgctgcatttaatggttatggtggaagttgctcatttataggttcggctaatcacgtattaacaaatcgccatgtcgctttaggcgccaatagtcaaattgatccagaagcgataaaatccagtgaaatgtgggttaactggcacaatattactaacgacttttcatcaccgattactgatattatccattttgatatcgataaggtattaacctacggcaaagaaattggtggggttgaggattatgccttatttactatcacagattttgattatcaaaatgctcacgttaaaactttatttggtggtctaaagcttcaagaaaccataaataatgagcgagaaaatatctatattccgcaacatggtggagcaaaaccgttacaaattagtgcacggctggtaagttctatgcatccttttgcatcaataacccctcagccagagtatggtgatttattcattctaggagatatggaaccaggatcctcaggctcccctctaattggtcgcgaaacacacaatatattaggaattttatgggggcgatttttatttacccaacatggcatttcatcaccataccttatcgataaacttaaagattttatttctgatagtaatattcatatcaaagcacaagataatattgtgtcacataatattgaagctactccggtcgataatgctgaaattaaagtgatattaggtgataaagaacaattgattccttttgataccattcttgttgaaaaccatgatggctactctattgtcgaaatggctggattggatcttacaaccagaaaaactatgccagtaaaatataaagtcttggcaattatgtctaatcaccaggtaagccatcttaatgatcctgcgttaattggtgaagtaacgctgagatttattccttatcaacatctacaagacacggttattaaaagctggtttgttgctcgaatagaacgagatggagaaattgttaacaattacattactcgcatcttaagctataactacgatgtcttcgaaataccctttgatgttaacaatgcagattgcatgccattaatttttgatgccaagcaagctaatactattctacacccatttaccgaaaccaatcctaatttatcattttatactctacgccatgggcaaggaccagaaaatgttggtgaaattagtgatggttactcaattctaaaaacacaagtcattaatgcaaaaggtgaaaaagagctagttactttccaggcatatcggattaaatcagtaaccgcaagtgagccttaccctttgatctctactccaagcagaattaatgtaaaatgtaattatgactttaaaggaccatcatatttaagagtctgttattaccccgaagataatctgcatttaattggtaaaggaacatttaaaggtattattgcgctccatggcagtgatgaaagtggttctacagatcgtttatgtaaaaatattctattagatattacaatcaacggataa

SEQ ID NO: 90 - DNA, 3786 bp, Yersinia Sp.
atgtttatgccattcagagaatttatttctagccatgtcgggcgtcaccccctcttcaaccgcgctcctgtcgccgtgattaatcccatcacattggcgattattgttgcgttctccacccttgccttaccacaaaccgcacgggcgtcgtgcaacaattcgggggggagtacctatatctgtgaaggtgaaaataacgccgggatcatcctaagtggaacggatatcacggttgagacccagctcggttttggcatcatagagcctggagatatagatcctgcgctctcattaatcggctctggtgccatcagctaccttgataccaacagttctgcgcttgataccgctggtgcctattctttgtctatccagaatgatacgtcgatgattgggcaatcgacatccactaacgttcaggccaacggttcaattggcagtggtatctatattagcagccagagtcgcgacaactcgaccatacaggtagacctctccggcatgttatccagcggcctgaatggcactcctgccctttcaatcgactcattggcagacaatgattcaactatcattctgaacatccatgctatttcaggtattgcgggtatccaaagcgataataattcacggtacggaacggccatcaccaatgttgatattgccaacgatatcaacgtcgaatattcaggagcctcgatccaaaattattccaatagtggcaccagcatccttaatttaaattcaaagagtatcagtacagacttcgacgccttggatattaataatagcaattattcaggggaggtgatgaccgatatcaatatcgatggcgatatcagttcagccaatagtcaagctgccaggatttacaatcataccaatagcggtctttcgagccttagatttcgcgcaaataatgtcacgggtgaatatgctggcctttatatcgataatagcagccagaatggcgctgtaaccgatattatattgacgggtgatcttacggctacttcaggatctgctctgtatgccaatacctactcggaggaggggaacgtcgagaccgctatcaagttgaataacgtttattctctgtatgacgcactcaatatttacggctataaccaaactggaaatacactgtttgaccttgatgtctcaggcacggttacttcagaaaatggtaccgggattaaagtgatgggaacgacttttgaaggcaattccactatactcatcaatgtgaataacattacttccagcagtcaatcgcttgatatcaacaattacaattcttcgggttcagctctttctgccattactgcaaccgggcatctcgctgcggaatggggacaaggggtaacgttccaaacctattcctctctgggggatgctaccacgctcatccatgtcaatgacattacttcaatggggaatgggatatatagccttactgaggctagccggggtacagtaaccaccgacgtcaccgtgacgggccagattaacgtcagtgatggggagggtataacccttaatacgcagaccattgacggcaataccctggtcaacattgacgtcaataatatcgccagtgaatacgatgctatccacctctataacaataacaacaccacaggcgtggataatggcacaggcgtagacaacggcacatcgaccattgatctgatcacccggggcgcgctggtttcgcagcagggctacgggattaatcttgaaaccaataccgcagacacctatgtcactgtgggcggcttggtgcacggcggcaacggctccgcaattggcattcatcggcttgataacattcaaacatcagccacgttagagctgcaatctggctatgcccttgaaggggcgacacagtcactggtatttactggcaattacgtggatatcaatgatgccgcgctggatctggcaaacagccatctggtgctgggcggaacaggagatgctgttttcgatctcacgcgtattgataaccgtgaagaggccattctggatggcgacccgaaccggatcaccggtttcggcaccctgaccaaaaccaacagcagcatctggacattaaccggatccaatatggccgacggtgacgccaatgccttcctgtcggccaatatcgccggggggattttggtgctggataacgccacgctgggcctgacacctgacgctggggcactgactggagccacagtaaaccgcctcagtgctgccgatatcgccgctgacccgacgcgggtggctaccgaaaccggtgcattaaccctggctgaaggcggcgcgctgtcctcgctcggtgactcggttctgagcggcaacctcatcagcgctggcgggatcctgctgtcaaaccactataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtggccggggcgtatgcctacaccttacaggccgacggggaagccgctaccgcaggccgcaactggtatctctcgtcagaactgatgctaaccgagggggtacgctatcaggtgggggtgccgctgtatgaacaatatccgcaggtgctggccgccctgaacactctgccgacgctgcaacagcgtgtcggtaaccgttacggggcaccgggtgcgctggcagacctgaactttgacgataatcaatgggcctggggccgtattgaagggagccaccaggtcaccgacccggcccgctccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcacaggttacggtcttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacgcactgggtaacgggttgtcactgaccccgcagatgcaggtgacctactcgcgggtcgatttcgataccttccgcgatccgtttgatagcgaagtctcgctgcaagagggtgacagcctgcggggccgcattggtgtctcactggataaggaaacgacctggagcgcgaaagacggcaccacccgccgctcacacatttacagtcatctcgatctgcacaatgagttccttaacggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgggtgagctggtaa

SEQ ID NO: 91 - DNA, 3021 bp, Paenibacillus Sp.
atgaaaagaatattttcattaagtataattattacagttattgtttctttatttagtccaactggaaagctccaaaactatacatatgctaattcagttcataaatctgtatacagcaataatccagtcgaacaatcttcgatcggaatattgagtacatcagtatacccagataatgctgtcgtgaaatatggagaaaagatatacatcaattatagtttcaatgataaggctcacccagtactcattaatatttataaagatggtgacttacaatcggattattattatgaacaatcaagttggggagaccatttttcttatgaacccaaagatgaaggaagctatagatttgttgtacagccgaccgatcaaccttactatactaatgagtgtacagttacagtttataaagatagaataatatttttacctggaataatgggaagtgagttgtttctgggcgatgagcaagtatgggagcctgagaatagcaaaaatcttcctcgcattcgtagccaaattaatagccttcaaatgaccactttaggagaaagtaaaaataacattagcgttcacaacagtatcagtgattatgatgacattttagccttctttaaaaacgaaggatttcacgtcgttgattttccctacgattggagattaggctccagtataaatgcacagaagttgaaagaaagaataaatattgagcgggctgcgtctccatatagtaattattacattgttgctcatagcatgggaggaattgtcgccactgaatttataagacagggaaatagtaatttaataaaaaaaatgattacaataggcacaccatttctaggcgctcctcaagctatcaacatgcttgaaacagggaatctgacagacaatttattagccgttctactggcaggcgatgcagtgaaaaatctggagaaaaatgttccctctatatatgaattacttcctacaaaggactatttttcttaccaaaccaatggatacattgagacccaaacatatcaagatccgtacggaccgagaatgaaggttagaaagtataatactttcagtgatacagagagctatataaaaaatagtagagattggtcaaataatggtttgtttgacaaagcaaaagatttccactctgctttggatgtgctcaatactcttaagaaagtagattcttactttatagtaggtgatcagaaaacaacacctggtaaacttgtataccactctctttcaataaacgataaagttcttgctgatgtgaaaagtatacagggagatggtgttgttccggtttccagtgcgacagtaggttttaagcttgataaggcacgaactttttatattaccagatctcatttaggtctagtaaaaagtactgaagtacagcaaaaaattctaaagattttaaaagataaacctaatgaatttgtctctgataaaattcgtaatgagacaaaagaaataaagactataaaattcaaagcagaatgcccggtagagctgcatataaatgattcatctggtaatcatacgggaccaacaggcgccgaaacatttgagtcaaatattccagatatcaattattttacagatggagaaacaaagattgctctagttaatgatgttgaaaactataaagttcgtatcgttggtacaggatatggtgaattaaccttctcaattgtatggtcaaacgaaaaagatattgaagatagaacaatgcgttttgacaatgttgctgttactcctggctcaatatttaaagctgatgttaatcagaatgggcaagtggtgcttcagatagatcagaatggcgatggtaacttcgaaggtagcgttagtcctactgtagaactagatctaggaggtactcaagacgaaacaattccaacaataagctcacatgtggatggagtaaaaggcataaatgaatggtatgggaaaaacgctttttataacttaaccggagctgataatgcgtctggggtttataaaaccttttatgatcttaacgattcagaatttaaggaatacaatgagccaatagcactccctaatactggtatatataatttcaagtcttatgttcgagataaaaatagaaatgattctgaagtattaactgaaattgtgaaagttgacactaccagtccgacagtgccagtaatgacagttgatccaacaacatggacgaataagtttgtcactattacattagatggtggaaccgatgcggatagtggatttcaaaaatatcagtacaagataaatcaggacggagaatggaaagattataaagatccttttgtgattgatacagaaggactatacaatgtttacgccagatcagtggataatgtatttaaccttagtggggaagttactggggtaactaaagttgataaaacgaatcctcaaaaaccactaatgaaagttgaaccattaaagtggaccaatcaatcggttgagattacgctgtcaggtggaagcgatacggacaagggttttccaaacagtgggttccaaaaatatcaatataaaataggattagacggagaatggaaggactacaccgtaccttttatcattgataatgaagggttaaataatgtatatgccagagcagtagatatagctgctaatctcagcgacgaagttttcggcgacgcaaaagttgataagacgagaccgtctaaaccaactggatttgatattgatttatttaattatgataacgtgaggatatcttggtctccttcctctgataatgtgggcgttacaggttatgatatttatcaagattctatacttttagataatattactgatactgcgtatacatttaataatctggaatctaataaatcatacaccttcaaagtaattgcatgggacgaagcagggaactcttcacttgaaggagtaaatgtagttcgaactccattgagtcttgttggtacaggaagagatcacagccttcacagcatggggtcgtaa

SEQ ID NO: 92 - DNA, 1065 bp, Bacillus Sp.
atgcctaacctagaaacaggtgtcgcctataatattgcactaggaacgaatccaaatttagtatttgatattttaggaaatagtacggaatatgatgcattagtaggtttatatgcaaaaggaaataatagtatcaatcaacaattttacttttttgaattagatggaggaaaacttgccgtcgttccaagaaatagtggcagaccgcttgaacctggatttggagaccagccagagaatcggattgtgcaaggggcatggacgggtacaattagtcaacagtgggcgttacaggatagaacggcatccagtgttcatatgtttaatcaaagtgatggggccgttgcgagttatggacggaacgaccaagaacagtttcctgaattgaatccacctgatccatcaggtcccaatcctgaaagagcttggtatcttgaacctgcttatcaagcgctattaccaaatatggtttcgacaacacctatcccttctccaccagaatattcttctggtatatatgaagtgttaccagaccaatcagaagtggctactgtatcgaatgctttgatcccttgcattttagtcaatgacggttctgtaagtcctgatataaaagtgcaacaatctccctattatttgttgatcaaacaacaatattggcaaaaagcagtattcggtaccgtttctccaaatactacaagagaatttttgtttcaatccggtaccacttccctagatcaacaatcgatgtcggatacaatcaatatgacaattggtggagatttcggattacaatttaataaggtaagtgcacccgctaagtttgtcatttctaaccaaattcaaacagtagtcagtacaacaaacgaacaattatctggatttacagacacgattgaatataggaacattaagaaaaatgtcttagtaggtgtttcgatctatcaacttgtgacacgatatgttttatatcgaacagacggttcattagtcgcagaaccttggaaatttattgataatgcatccgcagtgacgattatcactgagcaaccaatcgatgcataa

SEQ ID NO: 93 - DNA, 2463 bp, Brevibacillus Sp.
atgaaattacctaaaatgtataagtgtttattagctactgcactcctcggttcattcacatcctatccagagctatcacatgcggcttcaagcgagaaagaaataataaacgaccaagaagcgaattttaaaggcctattgggctactacttcaatgataaagagttaaaagaaaccgcactgatttctaattctgagtctggagatctattcgttgataacgatcaaatcgatgatatgttacctgatgaattaaaacaatttcaatctgccatgtggagaggatttattaaggtagaaaaatcaggtgaatatacgttctccacgtctgataatgaccacaccatgctatggatagatgatcaccaagttatcgatcactcctccgctacgcaaaaaatcgaactagaaaaagggaagctttataaaataaaaatcacttatcagccagaatcctcctctgctaacgaatttggcttacagcttaactggattactccacaaggaaaggaagaaatcattccagagggaaatctactgcttcctgacataaaaaatcaaccagagaatgaatctagcagaaaaaaaagaagtatttcagcttctgatgacggagttgaagatagtgatggtgacggcatccctgattccctcgaaatcgaaggatacaccttggatgtcaagaataaaaaacttatcctgatgccttggattgaaaaagtccatggaaaaaaacgcacgaaatctggagcaccgttaacaaaatatacatcttcacctatgaaatggagcaccgcatctgatccatatagcgatttcgccaaagtatcaggaatgattgataaaaaggtaaaagtgaaacatccgttgatcgcggcgtatcctaatttacaggttcatatggacaaatttattatttcaaaaaatagaaatgaaacgctagaaaatggcgggaatacaagtagttcgatcagtggaagtacttccacaagcaatactcattcaacagaagcttctgttggggcggaagttcatgcttccttatttaactttggcggaagtgtatccactaattttagcgatagtaattcacagaccgtaaccattgatcgttcaagctctgagagtttgggaagaaactggtccaagtccttaggtttaaatgcaggagaggctgcctattttaatgcaaacattcgctatgtgaataatggtacggcacctatttatgaagcagcacctactacttcactagtactagggaaaaacgataccatcgcaacgataaaagcaaaagagaatcacctagcaaacgtagtgttaccagaccgtttttatccagataaagatcaagcagctatttctctacaaaccaaagacgatttcggttctagcccgatcacaatcaataaggatcagcttactattctggagcagacacagcaaatgcgcttggaaacagatcaggtttccggttatgtaggagtaattgatcctaaaacaaaattaattgtggtagataaagataaacagtggagtcatattatccctcaaattgaggaaactactgctcgactgatcttaaaaacaccagacaattcagagctggaaagacgagtagctgctgttgatcctgatgactacactgaacaaacgaagccagatgttacattaggagaagcgctccaattggcttttggttttgaggacaagcaaggaaaattatcttacaacaatacgagtatagatgattttagattagtgtttgatgaagaaactgctgaaaatatagaaaaacaattagaagatatggaaacaaaaaatatctataacgtccaactgcatgctcgaatgaatatactaatttcaccgaagaaggatgaacctggtgttcatgaagggttatctagctgggaaatagatggagaagacaattactataaatatgatgtgctgcaaactggctggcaaacgataaatgggaaaaagtattattttaatgaaaatggcactttagtacccaacaaagtaattgaggatggaacctatcaaatcaatacagcattaaaaaatacaagtctagttgattggaatagaagcgataataatatcacagtgtgggaaacgaacgatggaagtaatcaaaaatggaaattgaagtatgatgactctcaacaagcctatgtgattcgaagcgtagaaaataacgataaaattatggcttggaatgcttatcagaattctactaatgtatttgctacagcatttgaagggaaacccgaacatttttggattcctgaattgctaggtaatgatctctatatcttaaaaaacaagaaagatccgacaaaagtgttggatgtagatggttcaggcacttcaaacgggtccaacattcaggtaagtgattataaaggtactgataatcaaaagtggaaattagaacaattagaagcaaattag

SEQ ID NO: 94 - DNA, 1962 bp, Bacillus Sp.
atgtttaaagaaaaaaacaatggaagattaaaaaagattgttataattactgcggcttgcaccatgatgtcaatgtatggagcaccaatttctagtacaaaggcagcaatccgatcccatgctccatcagtttatgtaacaccacaaaatactgctgcttcagatattattagcatagactggtcaccagtcctaacagcacctcatacgtattgggctgtgcataactggaatcaagggggagagggtggtggttatgctggcttccaacaacaaagtggttttgatcaaaccggtaaacgtactctccattttgcgctttgggatccaatagcatcaaaccaagcaataaaagctgaatatttatcgccgatttcagaagccagtagatttggtggagaaggaacaggtctgaaggtacaaacaacttataattggaaagatagtgaatggtatcgaatgactatacgttcttggcaagaagatggccatacaaagtttggccagtggataaaagataataaattaaatcaatggaagttagttgctattatggatcatccagttgcgaatgttgcatttaaccatggtctatcgatgtttcaagaggactgggctggtaatggacaagatgtaagagaagcacgccttaaaaatggatacagcagaaaagtttcagatcaacaatggaattcttggaataatcagtgtatctctgggcaacatgatacgtcctatcaatacgatggaggagcaacttcagaatatatctgggttaaggcaggaggaaatactcaatcaactattggtactggaaaaaattttaatataaatcagccgagtcaaccagaaatgggaattctagattttgatattcaaaatattcgctttgaagataagaaattaaatgtttcttggaaattgaaagaacaaagtactccacaatttaaagggaaaattgaaatctatgataatgaaaagttaatgggacaacctttgaaagtcattgataatattaagtcctaccaaactgaggtaagtcaaactatgcaattgcctcaaacggcttttgctaaaattacattaacagacatatttgatcgaactgtagagaaaaaagtaggaattacaaatggaaattctgatattttagtagggaaccaatttgcatgttccctaaaaggatatagtgatcgagaaattgcaaaagtagattataataaagcggcagaagagttaaaaatcaaattagaagctggcgtaccgcatgcttactttaatagtacatatgcaagtattaaggttcaaaactcatctggtagcgtattatacaataaggaaatcgtggggaatagacaacaaaataccgaaagtcaaactgtgtctgtaaaagtggggaattacattgaattaactcatatagaaggagacgcagtaaaggaaaagacacgcgcaacattaacaaatcttgaaaataacaaaaatgagactattggaaagacagcaaggtatctggttactaaagagggattaaagaaagttgaaaaaatgccagagacaacaattcttgatggaaaacaatttgcatggtcattaaaaggatatagtgatcgagaaattacaaaagtagattataataaaacagcagaagagctgaaaatcaaattagaagctggcgtaccgcatgcttactttaatagtacatatgcaagtattaaggttcaaagctcatccggtagtgttatgtacaataaggaaatcatgggaaatagacaacaatatgctgaaaccaaaacagtacctataaaagtgggagattatatagaatttactcatatagaaggggaagcagcaaaggaaaaaacgcgagcgactttaactaaccttgagaatggaaaacaggaatatataagtaagaaaagaacatatcaggtcacatccacaggattaataagacaatag

SEQ ID NO: 95 - DNA, 960 bp, Paenibacillus Sp.
atgttgatgatgaaagaaaagaaaattgtaactgccattgcgattgcctccattagcgctttactcgccataacacccgcagtccctgtagttgctgcagcaggcgtaacaaatacggctgcaacagatgcgggtatcgtagattggtcgactcctatcgatcatgcaatggatatatatgggcagcatgcaggaaagccaggaacctatggggggagtggccttcttggaggttttactgatgtgaagtatcgcgaattttcggtagaagcggatggttcgccgatcctttcgaattcgaaaacggtatttgtgggatcaagcactttagttaatgattcagatatggagcaaacgctgagcacagacagtttcacacagcagtttaccaattccgtcactagctcaacgacgactggctttaaattcggagaaaaaatttcttctaagtttgagattcctctcgttgctgaagtgggggcagaagtatcgactgaatttgatttttcagatacatccagcaatacaaagactgaaactcatacttacacagctcaaccacaaaatataaaagttccgccacattcctctgttgaagttattgtcaaactggatacagtgaaggcgagtggaaatgtaaagctgcttagcaaaatgtcaggccagaagaccgggtctattatttattataatcctagtgttcaatatttctacaatctatcatttcatgatatcgtagacgaggcttcgaaatatgaaaagctatcaaatgtgtatgcaaacccagatgaaacgatcactttagtgggcgcaggcaattatgaagcagaatatggcacacaatttatggtacaagtaatgaagccgaagccactaaatgaaaatggaagagtaaaaagagaccttcatgaagaagactacgcttatgaggtaactccggtagtgaataaagcagaataa

SEQ ID NO: 96 - DNA, 1263 bp, custom Sp.
atgaaactgctggaactgaaatctgtttactctgaacaggaacaggaacgtttctacacccgttctatctctctgggtgactgggactactctgcgatcatcaaatcttctgttatgttcggtctgggtcagatcccggttgttggtaaagcgctgtctaccatcgttggtctgttctggccgaaaaacgaaaaagacgtttggcagaaatctctggacgaactgcgtgaatacatcgacaaccagatcctggcgaccatccagggtatcctgaacggtgaactgcgtgaaatccagaaaaaaatggaatacgttgcgcgtctgctggaagaatctccgggttctccggaagcgtgctctgaatacaaaaacctgcagttctacctggttggtaaagacgaaaaattccgttctttcgacgaactgaccaactacaaactgatgccgatgtacgcgtctatgatcctgctgcaggcgtcttactggaaaatgggtatcgacaaaaaagaccagatcggtctgtcttctatcgacctgaactctctgaaaaaccacatcgacgacctggcggactcttctcgtaactacatcaaccgtatctacgaaaccgaactggaccgtacctacgaaaactctcgtccggacgaagttgcgaacaacatgttcgcggttcgtggttactctctgctgcacggtgttgaagcggttgaagttgttaaaaacatccgtgacctggacttcgacaaacgtttcaacatcaacgttatctcttactctaccgcggttggtaccatcaccggtggtatgatcgcgcaggcgctgaccccggactctgaaatggcgcagccgctgtgcccggaagttttcggtcagcaggcgaaccgtatcgttcagatcatcggttactctggtccgcgtatcggttctgcgttccgtatcggtggtctggaaatcatcttcgaaaacggtgactcttctctgctgggtgaacgtgttggtaaccgtgacgttttcgacctgaacggttctcgtatcaaaaccgttgaaatgcgttaccagggtctgatggacgaagttaaattcaccctgtctgacggtcgtgttatgcaggttggtcagggtgaatcttactctggttacgttaaatacgaagttgaaggtcactacatctctggtgttttcctgtctcgtgaccgtgcgacctacccgggtcgtacctctaccgcgtctgtttctttcaacatggttccggcgatctcttaa

SEQ ID NO: 97 - DNA, 399 bp, custom Sp.
atgaaagaccagttctctaacaacgaaatcgaaaaactgtctcgtggtgttggtctggaaacctctccggcggacgaatctgttcagctgctgtctggtggtaccttcaccgttccgaaacacggttctgttcaggcggcgaaatactctaccccggttatcccggaaatccacaaatcttactggatcttcaacaccggtccggcgaacaaaatcaaagcggttttctactggtctcactctttcacctcttcttggttcgaatactcttctgttgaagttggtatcggtgaagaaaaaaaactgcaggcgccgtctaactctctgtactactctaaagttgttctgttcaacggtaccgaccagaacgcgaccgtttctgttaccgttgcgaaataa

SEQ ID NO: 98 - DNA, 399 bp, custom Sp.
atgaaagaccagttctctaacaacgaaatcgaaaaactgtctcgtggtgttggtctggaaacctctctggcggacgaatctgttcagctgctgtctggtggtaccttcaccgttccgaaacacggttctgttcaggcggcgaaatactctaccccggttatcccggaaatccacaaatcttactggatcttcaacaccggtccggcgaacaaaatcaaagcggttttctactggtctcactctttcacctcttcttggttcgaatactcttctgttgaagttggtatcggtgaagaaaaaaaactgcaggcgccgtctaactctctgtactactctaaagttgttctgttcaacggtaccgaccagaacgcgaccgtttctgttaccgttgcgaaataa

SEQ ID NO: 99 - DNA, 366 bp, custom Sp.
atgaaagaccagttctctaacaacgaaatcgaaaaactgtctcgttctgttcagctgctgtctggtggtaccttcaccgttccgaaacacggttctgttcaggcggcgaaatactctaccccggttatcccggaaatccacaaatcttactggatcttcaacaccggtgcggcgaacaaaatcaaagcggttttctactggtctcactctttcacctcttcttggttcgaatactcttctgttgaagttggtatcggtgaagaaaaaaaactgcaggcgccgtctaactctctgtactactctaaagttgttctgttcaacggtaccgaccagaacgcgaccgtttctgttaccgttgcgaaataa

SEQ ID NO: 100 - DNA, 1545 bp, Lactococcus Sp.
atgattaaaaaagccaaaatggagaagatgatgacaaaaaaattaatcagaaacttatttatattattgttatttacatcaataatagcagtatttggagttggaaaagtatacgctcaaggttcagtttcgagtaagagtctgcaggtttctgcagatggatcagactattatactttgggttctgacttttataatcattttgttgaacctacaactgttgatttaacgaagaacaaggttgtatataataaacagacactgatagtatttaatggaagaattgataaatggaaaatgtcctttataaaccaggattcatcaggaaaatcttggttcaaatttttatcttatccagaagcaactaaaggagacataaaaattacttatacaacggatggtatgaactattctgataataaaccaagtctcgaacaactcaaaggctatatggtcgaacttcttaaaccaattgtatatccagatgatgcaaataaccaagagaatgatatagaagtctcttttcaactttctccagatactgattacatattgagtaatttcaatttaaataaacagtttattccctttagtggagagtcatggttacaaaattatagtcctgatcccttctttactgatcgaaatcaactccaattcatttatcccaattattcaagaggagtggcagtagagtacgttgatgaggaaggaaacaaaattcataactcacaaactattagtggttcaaaaggagatgtttatgacgccagtacagatcaatacaagttggtattggatggttacacattagacacaactaaactaccacaaaatagtacaggaaattttgaagaagagcttcaaacggtcacttacatatattctaaaaatccagtggttgcagctgatgtgacagtaaggtatgtagatatagagaataatcctatttcagaagacatcattttacaaggaaatattggtgaaaactattatactgataaaaaagatattaaagattatactttaaaagaagttcaaggaaattcatcaggtcagttttcagaaaaggcacaaacagtttcttatgtatacacagaaaatgagttacctattgctacaggaaaagttgttgtaaaatatatagatacagatggaaaatcaatttcaaaagatgttgttagatctggaactgttggcgaagattatataactgaagaaaaaaagatttctggttatacccttcaagaaattaaaggaaactcaaaaggtaaatatactgctaaagttcagactgtaacttatgtttatgctaaaaatgagataataaaagccaaagataagttaataagttctgagaccaaatccaaaaataaaacaaatccaaaagtaaaaaattctagtcatgtaaatccaaaaagactaccagaaacagctgagaataaaaaaaagagtataataattttccttagtggctttactcttataatcataggattagctattataacatttcgtctaaaaaaactggtaattaaaaaataa

SEQ ID NO: 101 - DNA, 1521 bp, Lactococcus Sp.
atgataataaaaaataagatggtaaaaagacttataagtacttttttaatgtcattattgcttgcatcaatgatgttagtaattggagctggaaaggtttatgctcaaggttcagtttcgagtacgagtctacaggtctctgccgatggttctgattactatatcataggttctgacttttataatcacttcgttaggcctacaaccgttgacttagcgaaaaataaagttgtttataataaacagatactaacagtatataatggcagaatagataaatggaaaatgtctttcttgaatcaggattcatcaggaaaatcctggttcaaatttttatcttatccagaagcaactaaaggagacataaaaattacttatacaacggatgggattaactattctgatagtaaaccaagtctagaacagctaaaaggctacatggtcgagcttcttaaaccaattgtatatccagatgatgcaaataaccaagagaatgatatagaggtttcttttcaactttctcctgatactgattacatattgagcaattccaatttaaataaacagtttattccttttagcggagagtactggttacaaaattatagtccttatcccttttttactgatcgaaatcaactccaattcgtatacccagattattctaaaggagtaatggtgaagtatgttgatgaggaaggaaatgaaattcatgatccacaaactattagtggttcaaaaggagatgtttatgacgccagtacagatcagtacaaattggtcttagatggttacacattagacacatctaaactaccacaaaatagtataggaaattttaaagaagcgcttcaaacagtcacttatgtttattctaaaaatccagtggttgcagctgatgtgacagtaagatatgtagatatagagaataatcctatttcagaagatatcattttacaaggaaatattggtgaaaactattatactgataaaaaaaatattaaagattatactctaaaagaagttcaaggaaattcatcaggtcagttttcagaaaaggcacaaacagttacttatatatacaaaaaaaatgagttacctattgctacaggaaaagttgttgtaaaatatatagatacagatggaaaatcaattttaaatgatgttgttagaactggaactgttggggaagattatataactgaagaaaaaaatatttctggttatacttttcaaggaattcgaggtaattcaaaaggtaaatatacggataaaattcagaccataacttatgtttatactaaaaatcatattataaaaccaaaagatgaattagtaaattctggaacaaaaataataaataaaactaatccaaaagttaaaaactccagttctgaaaaatcccaaaaactacctgaaactggtgaaaacaaaaaaaggagtatattgtttttcattagtggactcactcttataactttagggtcaactattatagtatttcgacataaaaaagaataa

SEQ ID NO: 102 - DNA, 1521 bp, Lactococcus Sp.
atgataataaaaaataagatggtaaaaagacttataagtacttttttaatgtcattattgcttgcatcaatgatgttagtaattggagctggaaaggtttatgctcaaggttcagtttcgagtacgagtctacaggtctctgccgatggttctgattactatatcataggttctgacttttataatcacttcgttaggcctacaaccgttgacttagcgaaaaataaagttgtttataataaacagatactaacagtatataatggcagaatagataaatggaaaatgtctttcttgaatcaggattcatcaggaaaatcctggttcaaatttttatcttatccagaagcaactaaaggagacataaaaattacttatacaacggatgggattaactattctgatagtaaaccaagtctagaacagctcaaaggctacatggtcgagcttcttaaaccaattgtatatccagatgatgcaaataaccaagagaatgatatagaggtttcttttcaactttctcctgatactgattacatattgagcaattccaatttaaataaacagtttattccttttagcggagagtactggttacaaaattatagtccttatcccttttttactgatcgaaatcaactccaattcgtatacccagattattctaaaggagtaatggtgaagtatgttgatgaggaaggaaatgaaattcatgatccgcaaactattagtggttcaaaaggagatgtttatgacgccagtacagatcagtacaaattggtcttagatggttacacattagacacatctaaactaccacaaaatagtataggaaattttaaagaagcgcttcaaacagtcacttatgtttattctaaaaatccagtggttgcagctgatgtgacagtaagatatgtagatatagagaataatcctatttcagaagatatcattttacaaggaaatattggtgaaaactattatactgataaaaaaaatattaaagattatactctaaaagaagttcaaggaaattcatcaggtcagttttcagaaaaggcacaaacagttacttatatatacaaaaaaaatgagttacctattgctacaggaaaagttgttgtaaaatatatagatacagatggaaaatcaattttaaaagatgttgttagaactggaactgttggggaagattatataactgaagaaaaaaaaatttctggttatacttttcaaggaattcgaggtaattcaaaaggtaaatatacggataaaattcagaccataacttatgtttatactaaaaatcatattataaaaccaaaagatgaattagtaaattctggaacaaaaataataaataaaactaatccaaaagttaaaaactccagttctgaaaaatcccaaaaactacctgaaactggtgaaaacaaaaaaaggagtatattgtttttcattagtggactcactcttataactttagggtcaactattatagtatttcgacataaaaaagaataa

SEQ ID NO: 103 - DNA, 3732 bp, Advenella Sp.
atgaactattcatttcggtataaagcacttcattttcatacgcttattgcccttctattgggtggctctgcgtttgcaccgatacacgatgcagtcgccaatgcacaaacgagcaacccgcaattatttacgcccagcactggcggtgaccgggcaagcttcagaacgcccgagttttatgcaaactggggactcaatttacataagttcgatgcggcctatgcggcgggcgcaaccggccaacgagtaaaggtgggtcagctggacagcccgctatatatcgcacatcctgaattggcggggatcagcttcagcaccgttggcagctatcctttggccaccacgccgaaattcgatgcgggcacaggaaagcctgcctatcacggcatgcacgtcgcgggcatcatcgcagccagaaaggacggcaaaggcatgcacggcggcgctttcggcgccaccgatttcgtggcaggcgacttcgcaagactgtacgaagcgtatctgaaggcaggagaatctctgttcaagctcgggcaaaccatcgtcagctcgggtgcggatttcatcaatcacagttacggatacaactttgccaattacgcgtttcctgtagcccttcccgacagcaaaaccggcgcacatggcccggatattcgccacatgcggcaatatcgcaacaatgggcacatcgagttcagttctgccaacggtgtcgtcaatgtgagttcggctggaaatgatcgttattatgctgcattcaatgcagcgttcaacaaacacgacacgcgccccagattgttccgagggatcggaaatgccaccggcataaatagcatcccctatctgaattatctcgcgacggatctgaccgatgccgactggagccgaatagaaaagggtattgtaagtgcagtcattctgaatggcaccaacgatatcaacagttattcaaacatttgcggtatcagtaaatactggtgcatcggcgcggcaggcggcatgctggctgagccgaataaggcctatgccaccgccctgcccagcctgccttacccggtagactactattaccccggtgccagcggccagaagtacatttatgaacctctgaatggcaacatttcttcggacaaatatcggatcctgagtctcgcagtgaccagtaaagcaccacccggttcgcctgaggccgaggtcatggatccgaaaaacctgcagccgatataccggatggcaatgggtacgtccatggcagcgccgacactgacagccgggcttgcggtcacaaagtcccggtttccctatcttcagaactggcagatccgtgacattgtgctgagcacggcacaggatattggcgcgcccggcattgaccgtgtgtatggctggggcgcaatggacctggaggccgccatgggcggaccgcgcaccttgtttgcactaagcagggactatattgaaaagcttaaacaatacgaaatagaggctgcagacaaatacaatccgatcgttgcaaaagccgattattacgctacacaggcgtatgaactgaaattgcaaatgatcgacaatgcccaacgtgctgcagaagcggaaaaagcgggtgatcatcaactggcagcccaattgcttgcacagaaccagcaactggccccacaagaggcggcgtttcgcaggcaggcctatgagcatgagctcacgcgcatacagccgaacaacgcagcagacaccccggaaaacgcatttgaatatatcaattttgtggttaacattccgggcaaaaaaacagaagcctgcgccgaagatgcatgcgtggccgatgtctggaccaacgatatttccggtcccggcggtctggagaaaaaaggcgccggcctgctcgcgcttgcgggtaacagtcattataccggcggcacaaaaattaccgagggcgtgctgcaattcggtatcggcggcagaaccggcagcgtgaccggcaacatcatcaataacagctcgctggtttttgcccgttctgatgaatgggcctacaaggacaatattaccggttccggagacgttacagtgctgggtggtggcaccttccgtctgcacggcaacaatacctatacgggttccacccatgtctatgatggtcggcttgctgtcgacggttcaacgatctcacaaacaattgtttatagtggcgggatgctcagcggtacgggccgggtcggtggcattcaggtccgtcagggtgggattgtatcgccgggcaattccataggcacattgactgtcgcgcattcaggcgctaccggcgccgctgcgggcaatgcggtcttcgagccgggttcacgactggccatcgaggtcgatggtcagggcaaccatgacgtattgaaagttgaaaactacgcggatattcatggtggcgtggttgatgtcggtattgcccgtctatccagaacacaactggcgcaacaggtcagacagagcacgcaaaaaccgtatgagattctgactgccggtgcgggcgtgaccggcgctttcgatcaggcccggctcgatattgacctgccctttattgccgccggcttacgctactggccacagaccgtgggcctgacgctaggcagaagccagcttggctttgggacagcaggccagacctacaaccagaaacagattggcggaggcattgagtcactgacgtctggccaccccttgtatgatgccttactcacgtcggcctcacgccaggaagcagccaataacctgcagcagttgtccaatgtcgatattcacgcctcactcaaacaggtactgctcaacgacacgcgctacatgcgggatgccgccctcggccggaccgggtacgcggctgtccagtccaatgatcgtgccggcatggagcgcaagccgcatacggacacgaatacgaacgtgtggggcaaggtgctgggttcctggcaaaaacacaagggggatggcaacgccgccgggctggatcgcaatatcggcggcgtgatctttggtgtagatcatgtgatgaaccacaactggcgagccggggccctggtgggtctgtccaatagttcgctcaagagcgagcgcgcgtcagccaaagtagacggttatcaagtgggcgcgtatgctgccacagaacgcgaacattttggattgcgcgtcggtgcctccctggctcaccatgcaataaccacccaacgcagtggctttgtggacgtcaggtccggaaacaaggccaaatacagtgctaacaccatgcaagtctatggcgagcttggctacaaatttgcggcaaaagccgttgtcatcgaaccgtttatcaacagcgcatatatacatctgaagacccgcgcattcaatgaagatggggatgccagcaaggtatcgggcaaatctcaatcgactaatgttgtatccaatatcctgggcgcaagaatatcaaatgtcattgaaagtggctcaggtacagcaatcaaactgtccggcatgattggctggaattacaacgtcggagatattaatcccaaggcgtcagtgaagtatccaggcggcaactcattcgacgtccgtggaactccgctttcccgaaacgcgttcgtcactgaattggggatacaggccaaccccgacaagcgtctttccgcaggtttgtattatgacggccgattcggcaggaaggtatcggatcacaccttgtccctgggtatccggtatgcgttctga

SEQ ID NO: 104 - DNA, 3723 bp, Advenella Sp.
atgaaatgtttattccggtacaaagcgctacatgtccatacgcttgttgcgcttctatgcggtggctcagcctttgcaccgattcacgatgcaacggccagcgagcgcaagagcaacacgcagattttcacgcccaaagcgcgcggcgatcgggagggctttaggacatcggagtttttcgcaaactgggggctgaatcttcacaaattcgatgcggcctacgcctcaggtgcaacgggccagcacgtgaaggtgggacaactggacaatcccctgtatgtagcgcatcccgaactggccggaatcaacttcagccccgtaggcagtttccctctggctaccaaaccaaaatttgatgcaggcacgggaaagccagcctatcacggcatgcatgtggctggcattattgccgccagaaaagacggtaaaggcatgcatggcggggccttcggcgccaccgatttcgtggccggcgatttcacgcaactgtatgacgcgtacctgcaggcaggcgaatcgctgtccaagctcggacaaaccatcgtcgactcgggcgctgatttcatcaatcacagctacggatataattttggcaattacgcgtttccggtgacgcttcccgacggaaaaaccggcgcacatggtcccgatattcgccacatgcagcaatatcggaataatgcacatatcgagttcagttccgccaacggtgttgtcaacgtcagctcagcaggcaatgatcgctattatgccgcgttcactgcggcgttcaacaaatatgacgcacgtccccgtctgttccggggaatcggcaacgccaccggcatcaatagcatcccgtatctgaattttcgtgcgcaggacctgagcgacgagaactggagccgaatcgaaaagggtatcgtgagcgccgtcatcctgaatggcacaaacgatatcaacagctattcgaacatctgcggcatcagtaaatactggtgcatcggcaccgccggcggcatgctggcagaacccgataaagcgtatgcgacagcactgccttccctgcctcattccgttgactactattatcctgacgcaagcggccagaaatacatttacgaacaactgactggcaacatttcttctgacaagtatcggattctgagccttgccgtgaccagcaaagcgccgccgggctctcccgaatctgtcgtgatggatccgaaaaacctgcaacccgtctaccggatggccatgggcacatccatggcagcccccacgttgacggccgggcttgctgtcacaaagtcccggtttccctatctgcagaactggcagattcgtgacattgttttgagtacagcacaggacctcggcgcgccgggcattgaccgggtgtatggctggggcgcgatggatctggaagccgccatgggcgggcctcgcgccttgttcgcattgcgcagggattatcttgaaaagcttgaaaaatatgaaactgaagccgccgacaaatacaatcccgtcgttgcacaagccgattattacgctacgcaggcctacgaattaaagcttcaaatgatcgaaaatgcaaaacgcgcagacgaagcggaaaaagcaggcaataaggatgaagcagcgcgactgctcgccgtgaataaacaacttgcgccacaagaggccgcgtttcgcaggcaggcatatgagcatgaactgacgcgcatacagccgaataatgtggcggacacacccgagaatgcatttgaatatatcaactttgtggttgatattccgggcaaaaaatctgaaacgtgcgcagccgacgcatgcgttgccgatgcctggaccaacgatatttcaggcccgggcggactggagaaaaaaggcaagggcctgttggcactggctggcaacaaccgttacaccggcggcacaaaaattgccgacggcgtgctgcagttcggcattggcggtacatccggcagcgtgacaggcgacattatcaataacagctcgctggtttttgcacggtccgatgaatgggcctacaaggacagcatcagcggttccggagatgtgtccattttaggcgggggtactttccgtctgcagggcgccaatacctactctggtctcacccatgtttatgacggccggtttgctgtggacggttcagcagcgtccagggccatcgtgtatggcggaggcattgtcagcggcaacggccgggtcggtggccttcatgttcgtcgggacggaatcgtttcaccgggcaattcgatcggcaccctgacggtcgcaaaatcagatgcggcagggacaggcaacgcggtgtttgaaccgcattcgcggctggccatcgaaatcgacggccagggtcaccatgacgtattgaaggttgaaaacgaagcgcagatccacggcggtctggtcgatgtcggcattgccagtctgtccaggccgcagttggcgcaacagctcagacagagcacgcataagccatataccattctgactgccggcgccggtgtgacggggacattcgatcacgcgcgcctggatatgaacctgccctttatcgccgccggcttgcgctattcacctcaaacagttgggctgaccctgggtcgaaacaatcttgctttttacgatgtcggccaaacacataaccagaagcagatcggtagcggcattgagtcattgacgccaggtcttccgttatacgatgcgttgctgacatcggcatcacgccaggaagcaatcgacagtttgcagcagttgtccagtgtagacattcatgcgtcactcaaacaggtattgattagcgacacccgattcatgcgtgaggctgtcctcggtcgcgtaggaaatatctcggtcccgactggcggcgccggagtcgaccgcgaaccgctcgcggttgcgagcacgaacgtgtggggcaaggtgctgggctcgtggcaaaaacacaagggcgatggcaacgccgcccggctggatcgaaataccggcggcctgatcttcggcgtagatcatttattcaaccccaattggcgtgccggtgcgttggtcggcttgtccaatagctcgctcaagagcgatcacgcttcagccaaagtggacagttaccagctcggcgcgtatgccgcgacagaacacgaccgtctcgggctgcgtgtgggggccaccctggctcaccatgaaatcaccacccgacgcgctggctatttcgatatgatatccaggaacgaagccgattacagcgcaaacagcctgcaagtctatggcgagctgggatacaagtttgcggccaatgccgttgtcatcgaaccgtttgtcaacagtgcgtatacgcatttgcggaccagcgcattcgaagaggatggcgatgccagcgtggcatccggcaaacgtcaatctgccaatgtggtttccaataccctgggggcaaggatctccaataccattgaaagcggctccggtaccgagttcagactgtcaggcatgatcggctggaattacaactttggagatattgacccggttgcctctgtgaagtaccagggcggcaagacgtttgacgccagagggactccgatttcccgaagcgcattcgtaaccgagctgggtgtgcaggcagccttcaaaaagagcctctcgggaggtttatattacgacggccgattcggcaagaaagtttcggaccacgctttatcgctgggtattcgctataccttctga

SEQ ID NO: 105 - DNA, 4257 bp, Enterobacter Sp.
atgtttgaagctgcacgcgtaggtgatgatatcggccactccggtgcgcttgccgggatgattgccggaacgattgtcggcggcctgattgccgccgccgggggcattctggcgggggcgatgtttattgccggacttggcgcatcctgcctgggcgtgggcgtcctgctcgtcggcgcgagcctggccgtggggtactacaccggggagctggcgaccgccgcccgcgacagcatcgcggacgccggggcatccagtatgacgaagaaaggcgtcatcacctcaggctcgcccaatgtgtttatcaacggtaaacccgccgcgcttgccaccgatagcaccgtcgactgttctgacgacggctcgcagcagatggccgaaggctctatgcgagtcttcattaacagccagcctgcgtcccgcatcggggatcgtaccacctgcgacgcgaaggtgatgaccggttcggacaacgtcatcatcggcggcgacccgcagcaaaccctgcccattcagtctgaagtccccgagtggctgtataaagtctccgatcttaccctgttgttcgccggcctgctcggcgggtggggcggtgccgctggcaaagttggggcgctgtctaagctgctggggaaaattcccggtatcaataagctggcccgtatcgcctgccgcgccggcacgctgatgaccggcgttgccgccgcggggatcatcgcccgcccggtggatatcgtcagcggccagaagtttctcagcggggatgatgagctggacttcgtcctgccttcccgtctgccggtgcgctggcagcgctactggcgcagcggcaaccccggcgacagcgtgctgggccgcgggtggagcctgttctgggaaagccgcctggagccgtatcaggacgggctggtgtggcgtgcgccgtccggtgattacatcgccttcccgaatgtcccgaaagggatgcgcagctactgcgaaagcgaaaaaaactggcttgagcaccactctgacgacagctggtcggtgtatgacgtcagcggcgagcgctggcactacgcgccgcttaaggatgatgccccgtcgctgctccagcgcatctctgaaccctgcggcaacgctatcctcttcgagtggaatgcgaataatactctgcatgcccttaccgacagcgcgggccagcgcgtagtctgccgctacgaccgtgacagacttgccggtgcctggctggatgacgagatctgcctggtcagttacgcttatgatgaacagcgccagctggtctgtgtgaccggccggggcggtagcgtgcgccgacgcttccgctggcagggcggcctaatgagcgcccatgaggacgccaacggcctgctgagcgaataccgctggcaggagattgacggcctgccgcgcgtggtcggcttctgccacagcggcggcgaacagctgacgttcgaatacgattttgataacggcacccgccgtgcgacccgcgatgacggcgcgcaggcgcactggctggtggacgacgacgacaacgttgcgcgcttcacggattacgacggtcgtcagacgacgtttgtttaccgcgacggcgaactctgcgacgtcattctccccggcggcgcgatgcgccgcagcacgtgggacaaatacggccgcatgaccagcgagacggacccggcgggccgccgtacggagtatcactggtatcgcctgaccgaccgcatcacccggacagtgtatccggacggtacctcatcgcaggccatgtacgaccttcgcggtcgcttgctgtcggaaacggatccggccggtaacgccaccgcgtatgactatcccgacgatcgagaaaacctgccggagagcatcaccgacgccattggcggcgtggtgcgtctggtctggaaccaccaggggctgctgacgcagcgcacagattgctccggcagcgtgacccgctttacctacgaccgagtcgggcagctgattgccagcgaggatgcggaagggaatattacgcgccgggaatggagccgtgccgggctgctgagcgccgtgatccacccggacggcagccgtgagtcgctggtgtggaacgaacgcggccagctcacgggctggcgcgacccgctggaaagcgaagtgagctgggcctataacgcgctcggcctcccggtcagccttaccgaccgaattggccgcgtgcgccagtggcgctatgacccgcgcggtaacctgttgcgactcgataacggcaacggggcggaataccgcttcacctacgacgccgtgggccgcccgctcagcgaaacgcgcccggacgataccgtgcgccatatggaatgggacgcgcgagggttcctctgcgcgctcgaagagaacggccggcctgccgccgacggcggcatcgcccgtcgcgtccagcagttcagctatgacgacagcgggctgctgatcgggcgcactcagcgtcacgcggagtaccgctacttccgcgacctgagcggccagattacccgcatccgccgcacgccaaccgcagaaggcgttgccctgggtatcgaaagcgatgagattgtttaccggcacgatgccaacgggcgcgtgctgagcgaatccggtattaacggcgcggtgggctacgaatgggatgccctgagcaacctgaccggcctgacgctgcccggcgagcaaaagctggcctggctgcactacggctccggccacgtcagcgccatccgcttcgggcagcagctggtgaccgagttcacccgcgaccgcctgcaccgcgaggtgcgccgcacccagggcgcgcgcgagcagctccgtcagtatgacagcctcggcagacgcacccttcagcgcagtgagctgagtacggacgtgaccatgccggagaaggcgctcctggaacggctgtatcgctacaccgcgcgcggtgagctttccggcgtcagcgacaccctacgcggtgaggtagattacggctacgacgccgaaggtcgtctgctgaagcactacgaggcccgccaggggcacagccgcgcgcagttcagctatgacgccgcggataacctcgctgccagtgacgatgcggcaccggtcacggataaccgcctgcagcactggcaggcgctgttcatgaagtacgaccactggggcaacctggtcagccgccgaaacgggctgtatgaacagcattatgcgtatgacgccgagaaccggttggtatccgcccgcggaacccggccggaagggcggtttgaggcgcgctatcactacgacgcgctggggcgccgcacgcgtaaaatcgtcactacgacgcacggcaccaccgaaacgcgcttcctgtggcagggctaccgcctgctgcaggagcagcaggagagcgggctgtgcaacacctatatctacgacccgaatgaagcctggagcccgctggcgcgggtggaccatcttcgtgaccagaacagcggtgagatttactggttcaataccgacctgaacggcgcgccgctggaagtgaccgacgagcgcggcgcggtgcgctggagcggccagtacggcagctttggcgaggtacgtcatcagagcgaagggttctcacggcttgtgaatcgcacggcgatggcgcatcagccgcttcgctatgccgggcagtatgctgacggtgaaacggggctgcattataacctgttccgctactacgacccgcaggtcgggcggtttattgtgcaggatccgattgggctgaatggcgggtggaacctttatcagtatgcgccgaatccgttggggtggattgatccgtggggactctctgctcaaggtttagttcgttacaaaccagatccctcccttagcgcgcagccgggagccagggcgacagcaataagccgagcatggggagaagaaagagagctagttgcggctggaggtggaagccgagactggacggctgctgaacgtgaagtaatactaagcacaaaaaataatcgccaattatcgtcggttatgtccgaaatgggttatacaggccatcatatcaatagtgtgaaaggtaatggtgttctgggaggaaaatggcaaggcgatccaaggaacattgtatttctccagaatgctaatcatcctagcggctatgatgagcatttacatggtctacaaggtcaccgtggcagctatgacactccaggtaaaggacgattgatagaccgcaaccttacccgtaagaatttgaagagctgtcaataa

SEQ ID NO: 106 - DNA, 4239 bp, Enterobacter Sp.
atgtttgaagcagcacgcgttggtgatgatatcggccactccggtgcgctggccgggatgattgccggaacgattgtcggtggcctgattgccgccgccgggggcattctggcgggggccatgtttattgccggtctcggcgcatcctgccttggcgtgggcgtcctgctcgtcggcgccagcctggccgtggggtattacaccggggagctggcaaccgccgcccgggacagcatcgcggacgccggggcatccagcatgacgaagaaaggcgtcatcacctccggctcgcccaacgtatttatcaacggcaaacccgccgcgcttgccaccgatagcaccgtcgactgttctgacgacggctcgcagcagatggccgaaggctctaagcgcgtctccattaacagccagcctgcgtcccgcatcggggatcgcaccacctgcgacgcgaaggtgatgaccggttcggacaacgtcattatcggcggcgacccgcagcaaaccctgcccattcagtctgaagtgcccgagtggctctacaaagtctccgatctaaccctgctgttcgccggcctgctcggcgggtggggcggtgccgctggcaaagtcggggcgctctctaagctgctgggcaaaatccccggcatcaacaagctggcccgtatcgcctgtcgcgccggcacgctgatgaccggcgtggcggccgcggggatcatcgcccgcccggtggatatcgtcagcggacagaagtttctcagcggggatgatgagctggacttcgtcctgccgtcccgtcttccggtgcgctggcagcgctactggcgcagcggcaaccccggcgacagcgtgctgggccgcggctggagcctgttctgggaaagccgcctggagacgtatcaggacggcctggtgtggcgcgcaccgtccggcgattacgtcgccttcccgaaggtcccgaaagggctgcgcacctactgcgaaagcgaaaaaaactggcttgaacatcaccaggacgacagctggtcggtgtatgacgtcagcggcgagcgctggcactatgcgccgctgcgggatgatgccccgtcgctgctccagcgcatctctgaaccgtgcggcaacgatatcctcttcgagtggaatgcggataataccctgcatgccctgaccgacagcgcgggccagcgcgtggtctgccgctacgaccgtgacaggctcctcggcgcctggctggatgacgagatctgcctggtcagttacgcttatgatgaacagcgccagctggtctccgtgaccggccggggcggtagcgtgcgccgacgcttcagctggcaggacgggctgatgagcacccacgaggacgccaacggcctgctgagcgaataccgctggcgggagattgacggcctgccgcgggtggtcggcttccgccacagcggcggcgaacagctgacgttcgaatacgattttgataacggcacccgccgcgcgacccgcgaagacggcgcgcaggcgcactggctggtggatgacgacgacaacgtcgcgcgcttcacggattacgacggccgccagacgacgtttgtttaccgcgacggcgagctctgcgacgtcatcctgccgggcggcgcgatgcgccgcagcacgtgggacaaatacggccgcatgaccagcgagacggacccggcgggccgccgcacggagtatcactggcatcgcctgaccgaccgcatcacccgcacggtgtacccggacggcacctcatcgcaggccatgtacgaccttcgcggtcgcctgctgtcggaaacggatccggccggtagcaccaccgcgtatcgctatcccgacgatgaagaaaacctgccggagagcattaccgacgccatcggcggcgtggtgcgcctggtctggaatcaccaggggctgctgacgcagcgcaccgactgctccggcagcgtcacccgcttcacctacgaccgattcgggcagctgattgccagcgaggatgcggaagggaatatcacgcgccgggagtggagccgtgccgggctgctgagcgccgtgatccacccggacggcagccgcgagtcgctggtgtggaacgaacgcggccagctcacgggctggcgcgacccgctggaaagcgaggtgagctgggcctacaacgccctcggtctcccggtcagccttaccgaccgtattggccgcgtgcgccagtggcgctacgacccgcgcggtaacctgctgcgactcgataacggcaacggagcggaataccgcttcacctacgacgccgtgggacgcccgctcagcgaaacgcgcccggacgagaccgtgcgccatatggaatgggacgcgcgagggttcctctgcgcgctcgaagaaaacggccggcctgccgccgacggcggcattgcccgtcgcgtccagcagttcagctatgacgacagcgggctgctgatcgggcgcactcagcgccatgcggagtaccgctacttccgcgacctgagcggccagatcacccgcatccgccgcacgccaaccgccgaaggcgttgccctgggtatcgaaagcgatgagatcgcttaccgccacgatgccgccggacgcgtgctgagcgagtccggcattcacggcgcggtgggctacgaatgggatgccctgagcaacctgaccggcctgacgctgcccggcgagcaaaagctggcctggctgcactacggctccggccacgtcagcgccatccgcttcgggcagcagctggtgaccgagttcacccgcgaccgcctgcaccgcgaggtgcgccgcacccagggcccgcgcgagcagctccgtcagtatgacagcctcggcagacgcaccctgcagcgcagcgaattgagcacggacgtgaccctgccggagcaggcgctactggaacgcctgtatcgctacaccgcacgcggtgagctttccggcgtcagcgacaccctgcgcggtgaggtggactacggctacgacgccgaagggcgtctgctgaagcactacgaggcccgccaggggcacagccgcgcgcagttcagctacgacgccgcggataatctcgccgccaatgacgatccggtaccggtcacggataaccgcctgcagcactggcaggcgctgtttatgaaatacgaccactggggcaacctggtcagccgccgcaacgggctgtatgaacagcattacgcgtatgacgccgagaaccgtctggtgtccgcccggggaaccgggccggaagggcggtttgaggcgcgctatcactacgacgcgctgggccgccgcacgcacaaaatcgtcaccacgacgcacggcaccaccgacacccgcttcctgtggcagggctaccgcctgctgcaggagcagcaggagagcgggctgtgcagcacgtatatttacgacccgaatgaagcctggagcccgctggcgcgggtggatcaccttcgtgaccagagcagcggtgagatttactggttcaacaccgatctgaacggcgcgccgctggaagtgaccgacgagcgcggcgcggtgcgctggagcggccagtacggcagctttggcgaggtacgccaccagagcgaagggttctcacgggtggtgaatcgcacggcgatggcacaccagccgcttcgctatgccgggcagtacgctgacggcgaaacggggctgcactataacctgttccgctactacgacccgcaggtcgggcggtttattgtgcaggatccgattgggctgaatggtgggtggaatctttatcagtatgcgccgaacccgttggggtggattgatccgctgggtttaataaacgaatttggaatcgcaggctatggaagccccgtccatgcaaaagacggtttaactgcacatgaattattacaaaatgcttggctaagaaataatggcataataaaaggtagaatgtctggtattgcaactaccaacccagcgatagctttgcaagaaaacgctatgcataaaaccatatccaaattacaggccaaatatggattgcataatcctaatgtactaaaaaaccagtccgcattgcagaatatcaacaggaatactgcaattactcgaagaggtatttacgaagacttggtgaataacagaggttgggaacgtcaaaacgctaagaaatttgccactgaaacggcaatgaaacttagagaagagtctattgggtttgccagaaaaaatgggttgacaaaatgttaa

SEQ ID NO: 107 - DNA, 4224 bp, Enterobacter Sp.
atgtttgaagcagcacgtgttggtgatgatatcggccactccggtgcgctggccgggatgattgccggaacgattgtcggtggcctgattgccgccgccgggggcattctggcgggggccatgtttatagcgggcctcggcgcatcctgtcttggcgtgggcgtcctgctcgtcggcgccagcctggccgtggggtattacaccggggagctggcaaccgccgcccgggacagcatcgcggacgccggggcatccagcatgacgaagaaaggcgtcatcacctccggctcgcccaacgtgtttatcaacggcaaacccgccgcgcttgccaccgatagcaccgtcgactgttctgacgacggctcgcagcagatggccgaaggctctaagcgcgtctccattaacagccagcctgcctcccgcatcggggatcgcaccacctgcgacgcgaaggtgatgaccggttcggacaacgtcatcatcggcggcgacccgcagcaaaccctgcccattcagtctgaagtgcccgagtggctctacaaggtctccgatctgaccctgctgttcgccggcctgctcggcgggtggggcggtgccgctggcaaagttggggcgctctctaagctgctgggcaaaatccccggtatcaacaagctggcccgtatcgcctgtcgcgccgggacgctgatgaccggcgtggcggccgcggggattattgctcgtccggtggatatcgtcagcggacagaagtttctcagcggggatgatgagctggacttcgccctgccttcccgtctgccggtgcgctggcagcgctactggcgcagcggcaaccccggcgacagcgtgctgggccgcggctggagcctgttctgggaaagccgcctggagacgtatcaggacggcctggtgtggcgcgcgccgtccggcgattacgtcgccttcccgaaggtcccgaaagggctgcgcagctactgcgaaagcgaaaaaaactggcttgaacatcaccaggacgacagctggtcggtgtatgacgtcagcggcgagcgctggcactatgcgccgctgcgggaggatgccccgtcgctgctccagcgcatctctgaaccctgcggcaacgatatcctcttcgagtggaacgcggataataccctgcatgccctgaccgacagcgcgggccagcgcgtggtctgccgctacgaccgcgacaggctcctcggcgcctggctggatgacgagatctgcctggtcagttacgcttatgatgaacagcgccagctggtctccgtgaccggccggggcggtagcgtgcgccgacgcttcagctggcaggacgggctgatgagcgcccacgaggacgccaacggcctgctgagcgaataccgctggcgggagattgacggcctggcgcgcgtggtcggcttccgccacagcggcggcgaacagctgacgttcgaatacgattttgataacggcctccgccgcgcgacccgcgaagacggcgcgcaggcgcactggctggtggatgacgacgacaacgtcgcgcgcttcacggattacgacggtcgccagacgacgtttgtttaccgcgacggcgagctctgcgacgtcatactgccgggcggcgcaatgcgccgcagcacgtgggacaaatacggccgcatgaccagcgagacggacccggcgggccgccgcacggagtatcactggcatcgcctgaccgaccgcatcacccgcacggtgtacccggacggcacctcatcgcaggccatgtacgaccttcgcggtcgcctgctgtcggaaacggatccgaccggtagcaccaccgcgtatcgctatcccgacgatgaagaaaacctgccggagagcattaccgacgccatcggcggcgtggtgcgcctggtctggaaccaccaggggctgctgacgcagcgcaccgactgctccggcagcgtcacccgcttcacctacgaccgcttcgggcagctgattgccagcgaggatgcggaagggaatatcacgcgccgggagtggagccgtgccgggctgctgagcgtcgtgatccatccggacggcagccgcgagtcgctggtgtggaacgaacgcggccagctcacgggctggcgcgacccgctggaaagcgaggtgagctgggcctataacgcgctcggcctcccggtcagccttaccgaccgtattggtcgcgtgcgccagtggcgctacgacccgcgcggtaacctgctgcggctcgataacggcaacggggcggaataccgcttcacctacgacgccgtgggccgaccgctcagcgaaacgcgcccggacgagaccgtgcgccatatggaatgggacgcgcgagggttcctctgcgcgctcgaagaaaacggccggcctgccgccgacggcggtatcgcccgtcgcgttcagcagttcagctatgacgacagcgggttgctgatcgggcgcactcagcgtcacgcggagtaccgctacttccgcgatctgagcggccagatcacccgcatccgccgcacgccaaccgccgaaggcgttgccctgggtatcgagagcgatgagatcgcttaccgccacgatgccgccggacgcgtgctgagcgagtccggcattaacggcgaggtgggctacgaatgggataccctgagcaacctgaccggcctgacgctgcccggcgagcaaaagctggcctggctgcactacggctccggccacgtcagcgccatccgcttcgggcagcagatggtgaccgagttcacccgcgaccgcctgcaccgcgaggtgcgccgcactcagggcgcgcgcgatcagatccgccagtatgacagcctcggcagacgcaccctgcagcgcagcgaattgagcacggacgtgaccctgccggagcaggcgctactggaacgcctctatcgctacaccgcgcgcggcgagctttccggcgtcagcgacaccctgcgcggtgaggtggattacggctacgacgccgaagggcgtctgctgaagcactacgaggcccgacaggggtacagccgcgcgcagttcagctacgacgccgcggataacctcgccgccaatgacgatcctgtaccggtcacggataaccgcctgcagcactggcaggcgctgtttatgaaatacgaccactggggcaacctggtcagccgccgcaacgggctgtatgagcagcattatgcgtatgacgccgagaaccgtctggtgtcagcccggggaaccgggccggaaggacggtttgaggcgcgctatcactacgacgcgctgggccgccgcacgcgaaaaatcgtcaccacgacgcacggcaccaccaacacccgcttcctgtggcagggctaccgcctgctgcaggagcagcaggagagcgggctgtgcagcacgtatatttacgaccctaatgaagcctggagcccgctggcgcgggtggatcaccttcgtgaccagagcagcggggagatttactggttcaacaccgacctgaacggcgcgccgctggaagtgaccgacgagcgcggcgcggtgcgctggagcggccagtacggcagctttggcgaggtacgccaccagagcgaagggttctcacgggctgtgaatcgcacggcgatggctcaccagccgcttcgctatgccgggcagtatgctgacggtgaaacggggctgcactataacctgttccgctactacgacccgcaggtcgggcggtttattgtgcaggatccgattgggttgaatggtgggtggaacctttatcagtatgcaccgaatccgttggggtggattgatccgctgggtcttgccgttgacccaatcgccaagcttagtgagcgtggatacagtggtgttgttcaaaccccaactggcgggctggattattctggaagtaatgccttgtacaataaagctggcattaatcctgttgtctctattgaatataccggagattatttgcaagatttccatgctgcaaatatagaggctggattaaatcaaaaaacgacaccaagtggttatgtctggcaccatcttgatgattataatcctgaaactaacaaagggactatgcaattggttaaacaaagtgctcatcagggaatttcgcatactggtggcgttagtcagtacaaggctgccactggaaatgcctatactcatccagctagaaaccgtgcccgcagatccgttggaggaaaatgctaa

SEQ ID NO: 108 - DNA, 4215 bp, Thauera Sp.
atgtttgaagctgcacgcgttggtgatgatatcggccactccggtgcgctggccgggatgattgccggaacgattgtcggtggcctgattgccgccgccgggggcattctggcgggggcgatgtttattgccggtctcggcgcatcctgccttggcgtgggggtcctgctcgtcggcgcaagcctggccgtgggatattacaccggggagctggcgaccgccgcccgggacagtatcgccgacgccggggcatccagtatgacgaagaaaggcgtcatcacctccggctcgcccaatgtgtttatcaacagcaaacccgccgccatcgcgacggacagcgcggtgaagtgctcggacgacggctcgcagcagatggccgaaggctctaagcgcgtctcgattaacagccagcctgcgtcccgcatcggggatcgcaccacctgcgacgcgaaggtgatgaccggctcggacaacgtcttcatcggcggcgatccgcagcaaaccctgcccattcagtctgaagtgcccgagtggctctataaagtctccgatcttactctgctgttcgccgggcttcttggtggctggggcggtgccgccggcaaagtcggggcgctctctaagctgctgggcaaaatccctgggatcaataagctggcccgtatcgcctgccgcgccggcacgctgatgaccggcgtagcggccgcggggatcatcgcccgtccggtggatatcgtcagcggacagaagtttctcagcggggatgatgagctcgatttcgttctgccgtcgcgcttgccggtgcgctggcagcgctactggcgcagcggcaaccccggcgacagcgtgctgggccgcggctggagcctgttctgggaaagccgactggagccttatcaggacgggctggtgtggcgtgcgccgtccggcgattacgttgccttcccgaacgtgccgaaagggatgcgcacctactgcgagagcgaaaaaaactggcttgaacatcaccatgacgacagctggtcggtgtatgacgtcagtggcgagcgctggcactacgcagcgctgaaagatgacacaccgtcactgcttcagcgcatctcagaaccctgcggcaacgatatcctcttcgagtggaatgcggataatactctgcatgccctgaccgacagcgcgggccagcgcgtggtctgccgctacgaccgtgacaggctcgccagcgcctggctggatgacgagatttgcctggtcagttacgcttatgatgaacagcgccagctggtctgtgtgaccggccggggcggtagcgtgcgccgacgcttccgctggcaggacgggctgatgagcgcccacgaggacgccaatggcctgctgagcgaataccgctggcgggagattgacggtctgccgcgcgtggtcggtttccgccacagcggcggcgaacagcagacgttcgaatacgattttgaaaacggcatccgtcgcgccattcgtgatgatggtgcgcaggcgcactggctgattgacgacgacgacaacgtcgcgcgcttcacggattacgacggccgccagacgacgtttgtctaccgcgacggcgagctcagcgatatcattctgcccggcggtgcgatgcgctgcagtacctgggataagtatggccgcatgaccagtgagacggacccggcgggccgtcgcacagaatattactggtatcgtctgaccgatcgcatcacccggacggtctacccggatggtacttcatcgcaggccatgtacgaccttcgcggtcgtctgctgtcggaaacggatccggccggtaacgccaccgcgtatcactatcccgatgaggaagagaacctgccggagagcatcactgatgccctcggcggcgtggtacgtctggtctggaacatccaggggctgctgacgcagcgcaccgattgctccggcagcgtgacccgtttcagttacgaccgtttcgggcagctgattgccagcgaggatgcggaagggaatatcacgcgtcgggagtggaacaacgccgggttgctgagtgccgtgatacatccggacggcagccgcgagtcgctggtgtggaacgaacgcggccagctcacgggctggcgcgacccgctggaaagcgaggtaagctgggcctataacgcgctcggcctcccggttagcctcaccgatcgtattggccgcgtgcgccagtggcgctacgacccacgcggtaacctgctgcgactcgataacggcaacggggcggaataccgcttcacctatgacgccgtgggccgcccgctcagcgaaacgcgcccggacgagaccgtgcgccatatggaatgggatgcgcgagggttcctctgcgcgctcgaagaaaatggccgacctgccgccgacggcggcatcgcccgtcgcgtccagcagttcagctatgacgacagcgggctgctgatcgggcgcactcagcgccacgcggagtaccgctacgtccgcgacctgagcggccagatcacccgcatccgtcgcaccccaacagccgaaggcgttgcgctgggtatcgaaagcgatgagattgcataccgccatgatgccgccgggcgcgtgctgagcgaatccggcattaacggcgcggtgggctatgaatgggatgccctgagcaacctgaccggcctgacgctgcccggcgagcaaaagctggcctggctgcactatggctccggccatgtcagtgccatccgcttcgggcagcagctggtgaccgagttcacccgcgaccgcctgcaccgcgaggtgcgccgcacccagggcgcgcgcgagcagttccgtcagtatgacagccttggcagacgtaccctgcagcgcagtgagctaagtacggacgtgaccctgccggagcaggcgatactggaacgcctgtatcgctacaccgcacgcggtgagctttctggcgttagcgacaccctgcgcggtgaggtggattacggctacgacgccgaagggcgtctgctgaagcactacgaggcccgacaggggcacagccgcgcgcagttcagctatgacgccgcggataacctcgccgccaatgacgatgcggtaccggtcacggataaccgcctgcagcactggcaggcgctgtttatgaaatacgaccactggggcaacctggtcagccgccgcaacggactgtatgaacagcattatgcgtatgacgccgagaaccggctggtatccgcccgcggaaccgggccggaagggcggtttgaggcgcgctatcactacgacgcgctgggccgccgtacacgcaaaatcgtcaccaccgcgcacggcaccaccgaaacgcgcttcctgtggcagggctaccgcctgttgcaggagcagcagcaaaccgggctgtgcagtacgtatatttatgacccgagtgaagcctggagcccgctggcgcgggtggatcatctccgagaccagagcagcggtgagatttactggttcaacaccgacctgaacggcgcgccgctggaagtgaccgacgaacgtggtgcggtacgctggagcggccagtacggcagctttggcgaggtacgccatcagagcgaagggttctcacgggttgtgaatcgcacagcgatggcgcatcaaccgcttcgctatgcagggcagtacgctgacggtgaaacggggctgcactataacctgttccgctattacgacccgcagatcgggcggtttattgtgcaggatccgattgggttgaatggcggttttaatttatattcgtacgttcctaacccacttacttggatagatccattagggttaatgccatgggcatggaacccaaatggaatgggacaccatttaatcccacgaaacaaggccaacagcattggactaaccgatcttggtactatgaaaaatacgccaacgtttttcccggatccttatagtgctggaatgcatgaagaactacatagagctattaaaaatgatattggaaaaattcaggggccgtggcagggctctgcggaagatttattcaatgcgtctagccgtaatttagattccgtttcacatataagaggtgatttaaagattccttccacgggggaaatcttagccagaaatgtcactccgaaagaagcacattcaaaactgctggagtggttcaataataaacaaacaggtaaggcatcaggaggcagatgtggttaa

SEQ ID NO: 109 - DNA, 3600 bp, Thauera Sp.
atgtttgaagctgcacgcgttggtgatgatatcggccactccggtgcgctggccgggatgattgccggaacgattgtcggtggcctgattgccgccgccgggggcattctggcgggggcgatgtttattgccggtctcggcgcatcctgccttggcgtgggtgtgctgctcgtcggcgcaagcctggccgtggggtattacaccggggagctggcgaccgccgcccgggacagtatcgccgacgccggggcatccagtatgacgaagaaaggcgtcatcacctccggctcgcccaatgtgtttatcaacagcaaacccgccgccatcgcgacggacagcgcggtgaagtgctcggacgatggctcgcagcagatggccgaaggctctaagcgtgtctcgattaacagccagcctgcgtcccgcatcggggatcgcaccacctgcgacgcgaaggtgatgaccggctcggacaacgtcttcatcggcggcgatccgcagcaaaccctgcccattcagtctgaagtgcccgagtggctctataaagtctccgatcttaccctgctgttcgccgggcttctcggcggctggggcggtgcggccggaaaagtcggggcgctctctaagctgctgggcaaaatccctgggatcaataagctggcccgtatcgcctgccgcgccggcacgctgatgaccggcgtagcggccgcggggatcatcgcccgtccggtggatatcttcagcggacagaagtttctcagcggggatgatgagctcgatttcgttctgccgtcacgcctgccggtgcgctggcagcgctactggcgcagcggcaaccctggcgacagcgtgctgggccgcggctggagcctgttctgggaaagccgcctggagttttatcaggacgggctggtgtggcgtgcgccgtccggcgattacgttgccttcccgaacgtgccgaaagggatgcgcacctactgcgagagcgaaaaaaactggcttgaacatcaccatgacgacagctggtcggtgtatgacgtcagcggcgagcgctggcactatgcgccgctgcgggatgacgcaccgtcactgctccagcgcatctcagaaccttgcggcaacgatatcctcttcgagtggaatgcgaataataccctgcatgccctgaccgacagcgcgggccagcgcgtggtctgccgctacgaccgtgacaggctcgccagcgcctggctggatgacgagatttgcctggtcagttacgcttatgatgaacagcgccagctggtctgcgtgaccggccggggcggtagcgtgcgccgacgcttccgctggcaggacgggctgatgagtgcccacgaggacgccaacggcctgctgagcgaataccgctggcgggagattgacggcctgccgcgcgtgatcggcttccgccacagcggcggcgaacagctgacgttcgaatacgattttgataacggcatccgtcgcgccaatcgtgatgatggtgcgcaggcgcactggctgattgacgacgacgacaacgtcgcgcgcttcacggattacgacggccgccagacgacgtttgtctaccgcgacggcgagctcagcgatgtcattctgcccggcggtgcgatgcgctgcagtacctgggataagtatggccgcatgaccagtgagacggacccggcaggccgtcgcacagaatattactggtatcgtctgaccgaccgcatcacccggacggtccacccggatggtacttcatcgcaggccatgtacgaccttcgcggtcgtctgctgtcggaaacggatccggccggtaacgccaccgcgtatcactatcccgatgaggaagagaacctgccggagagcatcactgatgccctcggcggcgtggtacgtctggtctggaacatccaggggctgctgacacagcgcaccgattgctccggcagcgtgacccgtttcagttacgaccgtttcgggcagctgattgccagcgaggatgcggaagggaatatcacgcgtcgggagtggaacaacgccgggttgctgagtgccgtgatacatccggacggcagccgcgagtcgctggtgtggaacgaacgcggccagctcacgggctggcgcgacccgctggaaagcgaggtgcgctgggcctataacgcgctcggcctcccggtcagcctcaccgatcgtattggccgcgtgcgccagtggcgctacgacccgcgcggtaacctgctgcgactcgataacggcaacggggcggaataccgcttcacctatgacgccgtgggccgcccgctcagcgaaacgcgcccggacgagaccgtgcgccatatggaatgggatgcgcgagggttcctctgcgcgctcgaagaaaacggccgacctgccgccgacggcggcattgcccgtcgcgtccagcagttcagctatgacgacagcgggctgctgatcgggcgcactcagcgccatgcggagtaccgctacgtccgtgacctgagcggccagatcatccgcatccgtcgcaccccaacagccgaaggcgttgcgttgggtatcgaaagcgatgagattgcttaccgccacgatgccgccgggcgcgtgctgagcgaatccggcattaacggcgcggtgggctatgaatgggatgccctgagcaacctgaccggcctgacgctgcccggcgagcaaaagctggcctggctgcactatggctccggccacgtcagcgccatccgcttcgggcagcagctggtgaccgagttcacccgcgaccgcctgcaccgcgaggtgcgccgcacccagggcgcgcgcgagcagctccgccagtatgacagcctcggcagacgcaccctgcagcgcagtgagttaagtacggacgtgaccctgccggagcaggcgatactggaacgcctgtatcgctacaccgcgcgcggtgagctatctggtgtcagcgacaccctgcgcggtgaggtggattacggctacgacgccgaagggcgtctgctgaagcactacgaggcccgacaggggcacagccgcgcgcagttcagctatgacgccgcggataacctcgccgccaatgatgatgcggtaccggtcacggataaccgcctgcagcactggcaggcgctgtttatgaaatacgaccactggggcaacctggtcagccgccgcaacgggctgtatgaacagcattatgcgtatgacgccgagaaccgtctggtgtccgcccgtggaaccgggccggaagggcggtttgaggcgcgctatcactacgacgcgctgggccgccgtacccgcaaaatcgtcaccaccgcgcacggcaccaccgagacgcgcttcctgtggcagggctaccgcctgttgcaggagcagcagcaaaccgggctgtgcagaacgtatatttatgacccgaatgaagcctggagcccgctggcgcgggtagatcatcttcatgaccagagcagcggtgagatttactggttcaataccgatctgaacggcgcgccgctggaagtgaccgacgagcgcggcgcggtgcgctggagcggccagtacggcagctttggcgaggtacgccatcgggtttaa

SEQ ID NO: 110 - DNA, 4176 bp, Klebsiella Sp.
atgtttgaagctgcgcgtgccggtgatgatataggccattccggcgcgctggccggcatgattgttggcacccttgtcggcggcgcgattgcggcgctgggcggcattgctgccggtgcgctgatggtcgcaggcatcggcgcctcctgttttggcataggtgtgctgcttatcggcgccagccttgcagtcggctttctcgccggggaggtggcgaccggcgtgcgcgacggcattgccgaaggtatggcagcgaacatgacgaagaaaggcgtcatcaccaccggttctcctgacgtctttatcaatggtaaatctgctgccattgccactgacagtatggtggagtgcgacgacgacggttcgcagcagatggcggaaggctcctcccgcgtctacatcaatggcctgcctgccgcccgtatcggggaccgcactacctgcgatgcgaaggtgatgaccggctccggcaacgtccgtattggcggcgacccggagcagaccctgtcaattactccggaagtgcccgaagcgctgtacaagatttcagacctgaccctgctgtttgccgggctggctggcggctggggtggcgcggccagcaaggtgggcgcggtgggtaagctgttgtcgaaactgccgggcatcagcaaaatcggccgcatcgcctgccgcttcggcgcgatgctgaccgccatcgcagccggaggaattatcgcccgcccggtggatatcgtcagcgggcagaaattcctcagcggcgacgacgagctggatttcgtcctgccgtcgcgtctgccggtgcgctggcagcgttactggcgcagcggtaatcccggcgacagcgtgctcggccgcggctggagcctcttctgggagacccgtctggagcgttaccaggaggggctggtgtggcgggctccgaccggggattacgtctcctttcctcttgtagcaaaggggtaccggacctactgcgaagccgaaaagcgctggctggagcaccatcaggacgatacctggtcggtgtatgacatcagcggcgagcgctggcactacgccccgcttcagaacgataacccctccctgctgcagcgcatctctgaaccctgcggcaacgatatcctcttcgagtggaacgataacctcaccctgcacgccctgacggacagtgccgggcagcgcgtggtctgtcgctatgagggcgaccgccttgcgggagcctggctggaggatgagatttgcctggtcagttatgcttatgacgaacagcgccagctggtctcagtgaccggccggggcggcagcgtgcgcaggcgtttccggtggcaggatggcctgatgcgcgcccacgaggatgcaaacggcctggtaagcgaataccgctggcaggagattgccggtctgccgcgcgtaacggcttttcgccacagcggcggtgagcagttaacttttgagtatgattttgataacgggacccgccgggccgtccgtgatgacggggcacaggcgcactggctgattgatgaagatgataacgtcgccgccttcaccgactttgatggccggaagaccgcctttatttaccgcgatggcgagctgtgtgatgtcatcctgccgggcggtgccatgcgccagagccggtgggacaggtacgggcgcatggttcaggagacggatccggccgggcggcggacagaatattactggtaccgcctcaccgatcgcctcacgcgcaccgtttaccctgacggaacagttgagcagagcctgtatgacctgcagggacggctgctttcggaaaccgacgccgcaggcaaccgcaccacttaccactacccggatgatgaagaacctttaccggacagcatcaccgatgcgacaggcggagtggtgcggctggcatggaaccgtcagggactgctgacaagccgcaccgactgctccggcagcgtcacgcgttttagctatgacagattcgggcacctcatcagcagcgaggatgcagagggtaacgtcacccgccgcgaatggaatattgcgggacaactttctgccgttatccgcccggacggcagccgcgagacattacagtggaacgcgcgcggacagcttgccgcctggcgcgatccgctggagagcgaggtgcgctgggactataacctgctcggcctgccggtgagcatcactgaccgcatcggacgcacccggcgctggcattacgacccgcgcggcaacctgttgcggcttgagaatggcaacggcggagaataccgctttacatacgacgccgcaggccgtccgctcagcgaaacccgcccggacgacacgtcgcgccagatgatatgggacagccgtggattcctcagcgaactgcatgaaaatggcaggcctgccgtcgatggcggcatcgcccggcgtagacgaaccttcagttacgatgaaagtggcctgctgaccgggcgtactacgcgccatgcggagtaccgctatgaccacgacctgaacggccagctcacccgtatccggcgcaccccgacggcggaaggtgttgccctgggcattgaagccgatgacatcgcctttaaccgcgatgcggcaggtcgcctggtaaacgagtctggtgttaacggcgaactcagctatgaatgggatgcgctgggcaatctgacaaatatgacgctccccggcgggcagcagctctcctggctgcactatggctccggccacgtcagtgccatccgcttcgggtcgcagctggtcactgaattcacccgcgaccgtctgcaccgggaagtgacccgcacccagggcgcgcgcgaacagtcccgaagctatgacagcctcggcagacgcactgcgcagcgcagtgcacttatcacagaggtggccctgccagagcaggcgatactggagcgcctgtaccgttacaccgggcgcggcgaactggcgggcgtcagcgacaccctgcgcggggaggtgaattacggctacgacgccgaaggccgcctgctgaagcattatgagtcccggcagggcaacagcagtgcgctctttgcctatgacgccgccgataacctggccgcgaacgacgccccggtcacggataaccgcctgcagcactggcagagcctgtttatgcagtacgatgcgtggggcaacctgacccgcaggcgcagcgggctgtatgagcagcactacacgtatgatgccgaaaaccgccttgtatctgcccgcggaacggggccgcaggggcgctttgaagcgcactaccattatgacgcgctcggcagacgcatccgcaagacagtcaccaccgggcacggcatcagtgaaacgcgttttctctggcagggttaccgcctgttgcaggagcagcatcagggcgggcagtgcagcacctgtatttacgacccgaatgaggcctggagcccgctggcgcggattgaccatctgcgtgaggacaggatcggggagatattctggttcagtaccgacctgaacggcgcgccgctggaagtgacagacgaagagggtagcctccgctggagcgggcagtacggcagcttcggcgaggtccgccatcagaccgacggcctcacacggcttgcgcagagcaccgcgctggcgcaccagcccctgcgctatgccgggcagtatgcagacagcgaaaccggcctgcactacaacctgttccgctattacgacccacagaccggacggttcaccgttcaggatccgatagggttaagtggtgggtggaacctgtaccagtacgcgccaaatccactagggtggatcgatgtgttaggcctgacactgacaaaacttcaggaaatggtcaaggaagtacacagcttgcttgatgaatatgctcagggtcgtaaaactactgctataggtgtagacagcagcggtaactatcatctcgcatccagcgaacgtgttgtacctcctgtgcagcgtgtatgggcgaaagaaaacaacgtgaatgttatcagaggcgatggacatgccgaggagactataatgaaaaatgtctccgacattgagcatatcgacgcatcaagaagagtctgccttgattgcgaaggattaatgcatgagcatggtgtgacaaccgacacaccgaaatcaggaaagcgcagccgtaacaggcttaaagggtgtccttaa

SEQ ID NO: 111 - DNA, 4188 bp, Pantoea Sp.
atgtttgaagctgcacgcctcggcgatgatatcggtcactctcatgccctggcgggcatgattgcaggcactatcgtcggtggactgatcgctgcggcgggcggtattgctgcgggtgcattgatgattgccgggataggcgcctcctgccttggcgtgggcgtattgctggttggactcagtatcggcgtgggttaccttactggcgaactggccacagccgcgcgagacggaatagcggatgctggggcggccagcatgaccccaaagggcaagattaccaccggttcgcccaacgtctttattaacagtaaacccgccgccatggccaccaacagcatagtggcctgcaaggacgatggtccgcagcagatggcggaaggctcctcccgggtgtatatcaacggcctgcctgcatcacgcatcgacgatcgcaccacctgcgatgccaaagtgatgacgggctctgacaacgtctatatcggcggcgagcctgaacaaacgctgcctatccaacctgaagtgcccgaatgggtttataaagcctccgatcttaccctgctgtttgccgggctggccggtggcgtgggcggtgcggctggcaaggtcggcgcgctgggtaaattactgagcaagattcccggtatcaataaaatcgcccgggtggcctgccgtgctggtgccttgatgaccggtgtggcggccgcaggtattcttgcccgtcccgttgatatcgtaagcggccagaagtttcttagcggcgatgatgaactggattttgtgctgccctcccggctgccgctacgctggcagcgctactggcgcagcggtaatcccggcgacagcgtattaggccgtggctggaacctgttctgggaaacacggctggaacgttaccaggatgggctggtctggcgtgcgtcctccggcgattacgtctcttttcctctggtgccaaaaggccagcgtacctactgcgaagcggagaaacgctggctggaacatcatcgggacgacagttggtcattgtatgacatcagcggtgagcgctggcattttatgcccctgcgcgatgatgccccttctcttcccctctgcctgaccgagccctgcggcaatgagattcagttcgactggaaccccgatcacacattggctgcgctgacagacagtgccggtcagcgcgtaacctgccgctatgcgaataaccggctcgcaggtgcctggctggatgacgatatttgtctggtcagttacgcgtatgatgatatcggccaactcgttacggtaacgggccggggcggtagcgtgcgccgacgcttccagtggtgcgatggcctgatggtcgcccatgaagatatgaatggcctgctaagtgagtatcgctggcaggagatcgatggcctcccaagagtggtggccttccgtcacagcggcggcgagcagctggattttgagtacgattttgataatggcatccgacgcgcgcgacgtgatgacggcgttgaagctcactggctcattgacgatgacgatcatgtcgcccgctttaccgacttcgacggccgccagaccatgctggtttaccgcgcaggcgagttgtgcgatgtgattatgcccggcggtgccatgcgctgcagcaactgggaccgctatggtcgcatgacgcaggagatcgatccggtcggacgtcgaaccacttatcactggttccgcatgactgaccgtgtgatccgtacggactatcccgatctgagcgcgactcaggcggcttacgatcttaatgttcgcctgctgactgaaaccgatgcgctcaataacgtcaccacctatcactaccctgatgacacagaactgctgccagacagcatcaccgatgcaacgggcggcgtggtgaagctggaatggaaccgacaagggctgctgacgcagcgcaccgactgctctggcagcgtaacgacgtttagctacgaccgatttggccagcttgttcgcagcgtggatgctgaaggtcatgtcacccagcgcgagtggaatgacaagggacaactctgcgccattatccatccagacggtagccgggaaaccctacactggaacacccaggggcagctcagtgcgtggcgcgatccgctggaaaccgaagtccgctggacctataacgcactcggattaccggtgagcctgacggaccgcattggtcgcacgcgtcgctggcattacgatgcccgtggtaatctgctgcggctggaaaacggcaacggcggtgactatcgctttacctgcgatccgctcggccgtccattgagtgagatccggcccgataagacctcacgcaatatggaatggaatgctcgtggctttctcattggtttacaggaaaatggccagcccgctaatgacggtggcatagctcgacgctggcagcgctttagctacgacgacagcggcttgattacccagcgcacaacgcagcatgctgaataccactaccggcgtcatcgtagcggtcaacttgccagcctggttcgcacgccgaccagcgacggaatggcgcttggtatcgaagacgatgaaatcgcctttacctatgacgtcgcaggtcagctcttaacagaagctggtataaacgggaaactggattacgaatgggatgcgctgggcaacctcacccatctgaccctgccgggtgaacagcaacttgcctggctgcactacggttcgggtcacgtcagcgcgattcgctttaatcagcaactggtcagtgaatttacccgcgaccgcctgcaccgggaaattcgccgcagtcagggcgcgcgtgagcaggcgcgtcagtacgacagccttggcaggcgcacgatgcagcgcagtgaattgcatagcgaggtggtgctaccggaaaaagccattctggaacgcgctttccgctattcggcgcgcagtgaactggagtctgtcagtgatacgctgcgcggcgacattatctatggttacgatgatgaaggccgcctgctgaagcactacgaagccagacagggtcacagcacctcgcattttgcttacgataacgcggacaacctggcggcaaacgacgatgcactgcacgcgttgccagttaccgacaaccgtctgcatcactggcagaacctgtttatgaagtacgatgactggggcaacctggtcagtcgacgcagcggcctgcatgagcagcattttacctatgacgccgaaaaccggctcatcagcgccaaaggcaatggcccggacggcgggtttaccgcacactatcattatgatgcgctgggcaggcgcacccgcaaagtggtcagcacccagcacgatcgtaaagaagtccgttttctgtggcagggctatcgcctgttacaggagcagcatgaaaacggccagtgccagacctacgtgtacgatcccaacgaggcctggagcccgctggcgcgcatcgaccatatggcagcaggcgaacggggcgatgtgttgtggttcaataccgatctcaacggggcaccgctagaggtaaccgatgaacgcggcgacatccgctggagcggtcagtacggcagctttggtgaagtgcgtcggcagacagagggctttacccggctggcaaaacagtctgccctgccccatcagccgctgcgctatgcgggccagtatgcggacagcgaaaccggtctgcattacaatctgttccgctattacgatccgcaggtgggacggttcacggttcaggacccgatagggctggaaggcggctggaacctgtatcagtatgcgccgaacccgctgagttggatcgacccgttggggttgaataagtgtgggagctttacaaagaatcctgacgatatccatttcatgcaaagttcaattaaaaatcaaacgggcgagcataccgttctcaataacgcagctgctcttaaaaacggtactcttaagcccactgatttacccgcaattaaaatttggcaagactcaagcggaaaattatggactctggaccacaggagactggctgcattcaaactgtcagggctgaaagaaataccggtgcagtgggctacggagaaagaaattgctggccaaatgtggaaaatgactacgaaaacagatggaaaaagtatcattcttaaaatgggtgatggtattaagagagttataggtggctaa

SEQ ID NO: 112 - DNA, 4194 bp, Pantoea Sp.
atgtttgaagctgcacgcctcggcgatgatatcggtcactctcatgccctggcgggcatgattgcaggcactatcgtcggtggactgatcgctgcggcgggcggtattgctgcgggtgcattgatgattgccgggataggcgcctcctgccttggcgtgggcgtattgctggttggactcagtatcggcgtgggttaccttactggcgaactggccaccgccgcgcgagacggaatagcggatgctggggcggccagcatgaccccaaagggcaagattaccaccggttcgcccaacgtctttattaacagtaaacccgccgccatggccaccaacagcatagtggcatgcaaggacgatggtccgcagcagatggcagaaggctcctcccgggtgtacatcaacggcctgcctgcatcacgcattgacgatcgcaccacctgcgatgccaaagtgatgacgggttctgacaacgtctatatcggcggcgagcctgaacaaacgctgcctatccaacctgaagtgcccgaatgggtttataaagcctccgatcttaccctgctgtttgccgggctggccggtggcgtgggcggtgcggctggcaaggtcggcgcgctgggtaaattactgagcaagattcccggcatcaataaaatcgcccgggtggcctgccgtgctggtgccttaatgaccggtgtggcggccgcaggtattcttgcccgtcccgttgatatcgtaagcggccagaagtttcttagcggcgatgatgaactggattttgtgctgccctcccggctgccgctacgctggcagcgctactggcgcagcggtaatcccggcgacagcgtattaggccgtggctggaacctgttctgggaaacacggctggaacgctaccaggatgggctggtctggcgtgcgccctccggcgattacgtctcttttcctctggtgcccaaaggccagcgtacctactgcgaagcggagaaacactggctggaacatcatcgggacgacagttggtcattgtatgacatcagcggtgagcgctggcattttatgcccctgcgcgatgatgccccttctcttcccctctgcctgaccgagccctgcggcaatgagattcagttcgactggaactccgatcacacattggccgcgctgacagacagtgccggtcagcgcgtaacctgccgctatgcgaataaccggctcgcaggtgcctggctggatgacgatatttgtctggtcagttacgcttatgatgatatcggccaactcgttacggtaacgggccggggcggtagcgtgcgccgacgcttccagtggtgcgatggcctgatggtcgcccatgaagatatgaatggcctgctaagtgagtatcgctggcaggagatcgatggcctcccaagagtggtggccttccgtcacagcggcggcgagcagctggattttgagtacgattttgataatggcatccgacgcgcgcgacgtgatgacggcgttgaagctcactggctcattgacgatgacgatcatgtcgcccgcttcaccgacttcgacggccgccagaccatgctggtttactgcgcaggcgagttgtgcgatgtgattatgcccggcggcgccatgcgctgcagcaactgggaccgctatggtcgcatgacgcaggagatcgatccggtcggacgtcgaaccacttatcactggttccgcatgactgaccgtgtgatccgtacggactatcccgatctgagcgcgactcaggcggcttacgatcttaatgttcgcctgctgactgaaaccgatgcgctcaataacgtcaccacctatcactaccctgatgacacagaactgctgccagacagcatcaccgatgcaacgggcggcgtggtgaagctggaatggaaccgacaagggctgctgacgcagcgcaccgactgctctggcagcgtaacgacgtttagctacgaccgatttggccagcttgttcgcagcgtggatgctgaaggtcatgtcacccagcgcgagtggaatgacaagggacaactctgcgccattatccatccagacggcagccgggaaaccctgcactggaacacccaggggcagctcagtgcgtggcgcgatccgctggagaccgaagtccgctggacctataacgcactcggattaccggtgagcctgacggaccgcattggtcgcacgcgtcgctggcattacgatgcccgtggtaatctgctgcggctggaaaacggcaacggcggtgactatcgctttacctgcgatccgctcggccgtccattgagtgagatccggcccgataagacctcacgcaatatggaatggaatgctcgtggttttctcattggtttacaggaaaatggccagcccgctaatgacggtggcatagcccgacgctggcagcgctttagctacgacgacagcggcttgattacccagcgcacaacgcagcatgcagaataccactaccggcgtcatcgtagcggtcaacttgccagcctggttcgcacgccgaccagtgacggaatggcgcttggtatcgaagacgatgaaatcgcctttacctatgacgtcgcaggtcagctcttaacagaagccggtataaacgggaaactggattacgaatgggatgcactgggcaacctcacccatctgaccctgccgggtgaacagcaacttgcctggctgcactacggttcgggtcacgtcagcgcgattcgctttaatcagcaactggtcagtgaatttacccgcgaccgcctgcaccgggaaattcgtcgcagtcagggcgcgcgtgagcaggcgcgtcagtacgacagccttggcaggcgtacgatgcagcgcagtgaattgcatagcgaggtggtgctaccggaaaaagccattctggaacgcgctttccgctattcggcgcgcagtgaactggagtctgtcagtgatacgctgcgcggcgacattatctatggttacgatgatgaaggccgcctgctgaagcactacgaagccagacagggccacagcacctcgcattttacttacgataatgcggacaacctggccgccaacgacgatgcactgcacgcgttgccggttaccgacaatcgagtgcatcactggcagaacctgtttatgaagtacgatgactggggcaacctggtcagtcgacgcagcggcctgcatgagcagcattttacctatgacgccgaaaaccggctcatcagcgccaaaggcaatggcccggacggcgggtttaccgcgcattatcattatgatgcgctgggcaggcgcacctgcaaagtggtcagcacccagcacgatcgtaaagaagtccgttttctgtggcagggctatcgcctgttacaggagcaacaggataatggccagtgccagacctatgtgtacgatcccaacgaggcctggagcccgctggcgcgcatcgaccatatggcagcaggcggccggggcgatgtgctgtggtttaacaccgatattaacggggcaccgctagaggtgaccgatgaacggggcaatatccgctggagcggtcagtacggcagctttggcgaggtacgccgacagacggagggctttacccggctggcaaaacagtctgccctgccccatcagccgctgcgctatgcgggccagtatgcggacagcgaaaccggtctacactacaatctgtttcgctattacgatccgcaggtgggacggtttacggttcaggacccgatagggctggaaggcggctggaacctttatcagtatgcgccgaacccgctgagctgggtggatccgctggggttgagtaattgcggtgctccaaacaaaaagacatcttatgaaggtatcagtcgcagagatgcgtttaggcaagctaaaagggatgctggaataccaatgaatcaacatcctagctctatcacaagacccgacttactagatgggagtggtaaaaaaatattagatagtactgggcagccaataaaaactaggcaatacgaatttgttgacaaaagaggtcagtccgtctttctacaagaacatagtttaggacataccaaggctacttctggtcatggagctgaacctcattttaatcttaggcctcttgacaacttgaataccggttcagttcctggtactcatggtcactataatttcccataa

SEQ ID NO: 113 - DNA, 1680 bp, Meta Sp.
atgtcatcctgggtgcaccctattgcccgcagcttacttgcctgcggcgcgattacgctgctgacgattgcccctacccaggccgaccctgccagccagcaactacgagaccagcagcaagctcagcgtcaacgcgaacagctgcagcaactcgagcgtttgcaacgcctgcaaccgatcacttcgcatgatgacaggagcgctttcaccgacacctcagacaactgctggtcgattaccggtgtgcgcctgaccggtaatcaaaaacttccaacccaccagttgcagccaaccgtacaagcgttgtcgcagccttgcatgggcatcgccagcatcaaccagctgctcaagggcctgacccagcagtatgtagaggcaggctacccgaccagccggccataccttgctcgccctcctaagcatgagcaaccgctggatatagtcatcatcgaaggattcgtcgaatcgatcgagctgactgacggcgagctgccgctatcactccaaggcgcctttcccggcctgctgggcaaaccactgcatcttccggatatcgagcaagggttggaccagctcaatcgattgcgtgcctacgatctaggtatcgagctactcccaggcgaactgcagggtggaacccgggtagtgctgcaacctcgccaagtcacttcaccctggcacttggacacacgcctggacaatcgtggcagcgagctggtcggccgccaccgcctgaacctggggcttggcctggacagtccactgggaatgaacggcgacctgcgcttgtcgatggcttcgaccgtattcaatgcgcccggtcagagccgcgggctcaacctctactacagccttccctacgggccctggacttttaccctcaacgccagccggatgagctatcgcgcaccggtaccagaaagccacatcgtcagcaacggcaagagccgtttccttggccttggcgccgaacggctgctgtggcgtaaccagcgcggcatactcagcgccagcgcccgagtagatcgcaagcaactgatcacccgctccgatagcaccgtaattagcttgcagagcccgaccctggccacgctggaggcggggctcaatctgctctggatcgaccgtggcctgtggaatgcttacttgggcgtgagccagggaatggactggtttggcgccgatcgccccttgccacaagcgcagacgccgcgacctgatttcctcaagtaccgcgtcaacctgttgcatctgcgccagggacctgggcattggccttggcgctggcaaagcgagctgaccggacaatacagcgccgatgtcttgccagcggtcgagcaattccaactcagtgatgactctgccgtacgcgggttccgccagcacaccgcctccggtgccagcgctgcggtctggcgcaataccctcagtcaaccacttgaccttgcctggacccactcagtgcaggtgcgccccaccgtggggcttgacctgggctggacccgcttcgcgcgcgccagcgcttcgcaacgcttggccggtgctgcagcaggagtcgaactcagcctgccgcaaagccgcctgcgcctcgattaccagcgcgccctgtatgccagtgacaagcccgcaaaaggcctggagcgcggctactgggtgctggactggaccctgaccatctaa

SEQ ID NO: 114 - DNA, 1680 bp, Pseudomonas Sp.
atgtcatcctgggtgcaccctattgcccgcagcttacttgcctgcggcgcgattacgctgctgacgattgcccctacccaggccgaccctgccagccagcaactacgagaccagcagcaagctcagcgtcaacgcgaacagctgcagcaactcgagcgtttgcaacgcctgcaaccgatcacttcgcatgatgacaggagcgctttcaccgacacctcagacaactgctggtcgattaccggtgtgcgcctgaccggtaatcaaaaacttccaacccaccagttgcagccaaccgtacaagcgttgtcgcagccttgcatgggcatcgccagcatcaaccagctgctcaagggcctgacccagcagtatgtagaggcaggctacccgaccagccggccataccttgctcgccctcctaagcatgagcaaccgctggatatagtcatcatcgaaggattcgtcgaatcgatcgagctgactgacggcgagctgccgctatcactccaaggcgcctttcccggcctgctgggcaaaccactgcatcttccggatatcgagcaagggttggaccagctcaatcgattgcgtgcctacgatctaggtatcgagctactcccaggcgaactgcagggtggaacccgggtagtggtgcaacctcgccaagtcacttcaccctggcacttggacacacgcctggacaatcgtggcagcgagctggtcggccgccaccgcctgaacctggggcttggcctggacagtccactgggaatgaacggcgacctgcgcttgtcgatggcttcgaccgtattcaatgcacccggtcagagccgcggcctcaacctctactacagccttccctacgggccctggacttttaccctcaacgccagccggatgagctatcgcgcaccggtaccagaaagccacatcgtcagcaacggcaagagccgtttccttggccttggcgccgaacggctgctgtggcgtaaccagcgcggcatactcagcgccagcgcccgagtagatcgcaagcaactgatcacccgctccgatagcaccgtaattagcttgcagagcccgaccctggccacgctggaggcggggctcaatctgctctggatcgaccgtggcctgtggaatgcttacttgggcgtgagccagggaatggcctggtttggcgccgatcgccccttgccacaagcgcagacgccgcgacctgatttcctcaagtaccgcgtcaacctgttgcatctgcgccagggaccttggcattggccttggcgctggcaaagcgagctgaccggacaatacagcgccgatgtcttgccagcggtcgagcaattccaactcagtgatgactctgccgtacgcgggttccgccagcacaccgcctccggtgccagcgctgcggtctggcgcaataccctcagtcaaccacttgaccttgcctggacccactcagtgcaggtgcgccccaccgtggggcttgacctgggctggacccgcttcgcgcgcgccagcgcttcgcaacgcttggccggtgctgcagcaggggtcgaactcagccggccgcaaagccgcctgcgcctcgattaccagcgcgccctgtatgccagtgacaagcccgcaaaaggcctggagcgcggctactgggtgctggactggaccctgaccatctga

SEQ ID NO: 115 - DNA, 1683 bp, Meta Sp.
atgtcatcctgggtgcaccctattgcccgcagcttacttgcctgcggcgcgattacgctgctgacgattgccccgacccaggccgacactgccagccagcacctacgtgaccagcagcaagcccagcgtcagcgcgaacaattgcaacagctcgaacgctggcaacgcctgcaaccgatcactgcgcacgatgacgatgaggctgcctccgacaccgcggataacccctgctgggcgatcagcggcgtgcgcctggccggcaaccacaagcttgcgacccaaaccctgcaaccaaccgtacaagcactgtcgcagccttgtatgaacatcggcgacatcaaccagttgctcaaggggctgaccgagcactatgtaaaagccggctatcccaccagccgtccttacctggctcgacatcccgagcatgatgcgccgctggatatcatcgttatcgaaggcttcatcgaatcgatcgagctcaccgacgccaacctgccgctgtcactacaaggtgcgtttcccgacctgctggggcaaccgctgcatctgccagacctcgaacaggggctggaccagctcaatcgattgcgcgcctatgacctcggtatcgacctgctgcctgggcaaatgcagggtggcacccgcgtactgctgcagcctcgtcgagtcgcctcgccctggcacctcgacacccgcgttgacaatcgcggcagtgcgctgactgggcgccatcgcctgaacctagggcttggcctggacagcccgctggggctgaacgacgacctgcgcctgtcgctgctgtcgacggtactcgatgcaccaggccaaagtcgcggggtcaacctgtactacagcattccttatggcccttggacgttcaacctcagcgcgagccaaatgcgctatcgcgcgcccatcccgcaaagccacctgagcagcaatggcgacagccgcgtgttcggccttggcgccgaacgggtgctgtggcgcaaccagcgcggcatactcagcgccagcacccgactggatcgcaagcaactggtcaaccgcgcgaatagcaccgtcatcgcagtgcagagcccgaccctgaccaccttcgaagcgggcctcaacctgctgtggctcgatcatggcctgtggaatgcctatctaggcatcagccgaggtctggactggttcggcgccgaccggccctttccccaaaaacaggcgccgcgacctgacttcttcaaataccgcgccaacctgctgcacctgcgtcagggacctgcgcatttgccttggcgctggcacagcgagctggccctgcagtacagcactgatgtcctgccagtggtcgagcagttccagctcagcgatgactcggccgtacgcggcttccgccagcacagtgcctccggcgccagcgccgctgtctggcgcaacaccctgagccaagcactgccgctgaacttggcccagccagtccaagtacgccccactctcggcctggacctgggctggtcccggttcgcccgcagcagcaccccgcaacgcctggctggcgctgccgcgggcgtcgagctgagcctggcgcaaagccgcctgcgcctcgactaccagcgcgccctatatgccagcgaacgccccacctccgggcttgagcgaggcttctgggtaatggaatggaccctgaacatctga

SEQ ID NO: 116 - DNA, 3129 bp, Meta Sp.
atgaccgctcccgaacgtcgtctgctgccaaacgcagcggacaaaaccgccctcaaagccatcgccacgaccattgtgcagaactgcccgagcctgctcgatgcggccaggcaagttgcgatcgaactgctgaccgacaaagggctatccggcctcgatcccgaccaggtttatttccatcgattcaaaacggcgcaaagcagcgcgctgacctttaccggttgggaacacttgctggaaaagccttatgaaacgctcaccctcacgcagttggtgatccatcgctttcgtgcgaccgatcaagacaacgcagatttgctgggcctttactgtggcttctactcggatggcccggacgcggagaatttcaatcagaacaacgaagtgcgactgcttggcagcgatgtgctgaaggcattctgggccgttgatttcagcacgcgttacagcgatcaattggccaaattctggcaaacctcgtcggaagatttccgcgccatggcaaagtgcagtttcctcagtcaggcggtgcaggcgctgcaacagggggacgttgacggcaatgattttcaacgcatcgtcagctcgctgatcggccccgttacctggccggtaaccctgcaaatgctccgatcgacgtacccggtcggcgcgcaggtgcgcacgctggatctggacggtcacgtcgccaccaacgtgctgcgtctggtcgaagacagtggccggcagaccctttacctgccgggacaagcccaggcctttcggctgatggacactgcggcggatctgcactggtggttgctcgaacagatgaattcagagcagaaacgccctttgtttctcaagcacttctcgctggctgacagcaatcacatcaccgagaacctcactgatctgatgaaccgtttggtgagcacctggggccacagcgatcaccggatgatcaaccgcagcaacgttgcgatcagcggtgacgccttcacgtggttaagcgagtcgactcgcgcgggcatgattgccgaggcgcatctggtgctcacgtccaacagtgagctacgcaggaaactctggaccgggtatctgagcgccgggctgaaagtgttcggcccgatggcggccgtgggctggccggtggctttgcccttgatcggcgccggcgtcgcgaacatggggctgaacatcgatcaggcgatcaacggcattacggcgaccgaacgtagagccggggtgatcggtgcggtgctcagcgctatcgaaaccgtattcaatgtgccgttcctgatcggcaccggcgcgcaactggaagtcgggccacaggtcgagtatgccgaggctgaagagatgcgtggtctggtcgagcttgcctcggctgacacgcgattattgccacctgtggatccgccaaccgtcacagcggctgaagaagcaagcagcgagttggcaaacgagatccccagcggggcgacattggtcgacgccactgagcccttgaatacgcctgctacacggcaaggtccgacatttccacaagtacctgccagctatcgatgcaacgagttacttgcgcaacattccgtagaggcgacgccgggtaaatacgaaggcatttaccgcctcgacaaagagcccggccatgccatcgaaatggatggtgccgcctattacgtgcgctacttcgccgactcgcaggacagcggcaactgggcaatcatcaatcccgagcgccccaatcagttcgcttattcgttgccggtccgcctgggaagcgctggcaagtgggagcgcatgcctgcgctgcggctgcgcggaggtggccaatgcgtgggcaaggcgtgtgcgccggagacagatttgagcccttctgaggcaacaccatcggtggatctgccacgcgtcgaaccgcttcctggcgttccgtgcccgctgcgcctggttacggcgctcaaagatatttcagagacggaaaaacccggaatgaggagatgggcaatgaacttgcccaacgcttctgccgagtcaacaagcgctggacgccgttatttaccggctaccgatcgttatcaggcgcatttcagcgaacaacgaacagcactgctgaacaacgccggagaattctttcgagagctgaaatggacaaatctgccgggacggccgctcattccgcaaatcgatcccttgatgcaaaccgaagagctgatagatctgatgtttgccaataccgatggactggcggtcggtgaaaccctcgatcgcatcgccagcatgcgcttcatgatcgagaacatgccaacgttcgcgcggcatatcagaacgctctacgtgcgtggattgctgagtgatttcgcccaagaggacctcaaccatttctacctctctggagacatgtcagaggacctcactacctatttgtccagcctgggtaccgaccctgagaaccggttcaacatgctcgaattgatcacgtctgcccaagccaatggcgtccgcgtccatggactggacgcagcacaaacctgcacgctgaaagtcccactcacttcgatcgaagagcagatgatcaagacccgcctggcaacgcagatcatggagcgtgacaagctcctcaacagacccggcaagtggctggctctggtcgatgccacgaacaccaataccttcagggacctgccaggcataagcgaactcaggggcggtatcggtttgcgcatcgaagaagtctggcccgacgaggcagccgacgtcaggattgacccgggcgtggaagtcgctcgcggtccatttcacaacggggcgacgacaagcaacgccttcgaccctctgttcgctgacctgcgattgcaggtcaaggcccccgtgccgccatggaatgacgctacgctggaaaagcttctgcatcgcaatggcatgttcgtgatacgaaaaacagaacccggcacatacacactcgtgcggcgcaacagcgccagcaacatcgtgcaaacaagggtgcattgcaccgcagatggccggttttatatctgggaccagtcgatgcgccgcataaccggcatgatattccgcgacatcgccgcagtagccgagcgcctgatcgagctcggcatgaccctgcaaagtcgtttacccacctga

SEQ ID NO: 117 - DNA, 3129 bp, Pseudomonas Sp.
atgaccgctcccgaacgtcgtctgctgccaaacgcagcggacaaaaccgccctcaaagccatcgccacgaccattgtgcagaactgcccgagcctgctcgatgcggccaggcaagttgcgatcgaactgctgaccgacaaagggctatccggcctcgatcccgaccaggtttatttccatcgattcaaaacggcgcaaagcagcgcgctgacctttaccggttgggaacacttgctggaaaagccttatgaaacgctcaccctcacgcagttggtgatccatcgctttcgtgcgaccgatcaagacaacgcagatttgctgggcctttactgtggcttctactcggatggcccggacgcggagaatttcaatcaggacaacgaagtgcgactgcttggcagcgatgtgctgaaggcattctgggccgttgatttcagcacgcgttacagcgatcaattggccaaattctggcaaacctcgtcggaagatttccgcgccatggcaaagtgcagtttcctcagtcaggcggtgcaggcgctgcaacagggggacgttgacggcaatgattttcaacgcatcgtcagctcgctgatcggccccgttacctggccggtaaccctgcaaatgctccgatcgacgtacccggtcggcgcgcaggtgcgcacgctggatctggacggtcacgtcgccaccaacgtgctgcgtctggtcgaagacagtggccggcagaccctttacctgccgggacaagcccaggcctttcggctgatggacactgcggcggatctgcactggtggttgctcgaacagatgaattcagagcagaaacgccctttgtttctcaagcacttctcgctggctgacagcaatcacatcactgagaacctcactgatctgatgaaccgtttggtgagcacctggggccacagcgatcaccggatgatcaaccgcagcaacgttgcgatcagcggtgacgccttcacgtggttaagcgagtcgactcgcgcgggcatgattgccgaggcgcatctggtgctcacgtccaacagtgagctacgcaggaaactctggaccgggtatctgagcgccgggctgaaagtgttcggcccgatggcggccgtgggctggccggtggctttgcccttgatcggcgccggcgtcgcgaacatggggctgaacatcgatcaggcgatcaacggcattacggcgaccgaacgtagagccggggtgatcggtgcggtgctcagcgctatcgaaaccgtattcaatgtgccgttcctgatcggcaccggcgcgcaactggaagttggaccacaggtcgagtatcccgaggctgaagagatgcgtggtctggtcgagcttgcctcggctgacacgcgattattgccacctgtggatccgccacccgtcacagcggctgaagaagcaagcagcgagttggcaaacgagatccccagcggggcgacatacgtcgacgtcactgagcccttgaatacgcctgctacacggcaaggttcgacatttccacaagtacctgccagctatcgatgcaacgagttacttgcgcaacattccgtagaggcgacgccggggaaatacgaaggcatttaccgcctcgacaacgagcccggtcatgccatcgaaatgaatggcgatgcctattacgtgcgctacttcgccgactcgcaggacagcggcaactgggcaatcatcgatcccgagcgccccaaccagttcgcttattcgttgccggtccgcctgggaagcgctggcaagtgggagcgcatgcctgcgctgcggctgcgcggaggcggccaatgcgtgggcaaggcgtgtgcgccggagacagatttgagcccttctgaggcaacaccatcggtggatctgccacgcgtcgaaccgcttccaggcgttccgtgcccgctgcgcctggttacggcgctcaaagatatttcagagatggaaaaacccggaatgaggagatgggcaatgaacttgcccaacgcttctgccgagtcaacaagcgctggacgccgttatttactggctaccgatcgttaccaggcgcatttcagcgaacaacgaacagcactgctgaacaacgccggagaattctttcgagagctgaaatggacaaatctgccgggacggccgctcattccgcaaatcgatcccttgatgcaaaccgaagagctgatagagctgatgtttgccaataccgatggactggcggtcggagaaaccctcgatcgcatcgccagcatgcgcttcatgatcgagaacatgccaacgttcgcgcggcatatcagaacgctctacgtgcgtggactactgagtgatttcgcccaagaggacctcaaccatttctacctctctggagacatgtcagaggacctaactatttatttgtccagcctgggtaccgaccctgagaaccggttcaacatgctcgagttgatcaggtctgcccaagccaatggcatccgcgtccatggactggacgcagcacaaacctgcacgctgaaagtcccactcacttcgatcgaagagcagatgatcaagacccgcctggcaacgcagatcatggagcgtgacaagctcctcaatagacccggcaagtgggtggctctggtcgatgccacgaacaccaataccttcagggacctgccaggcataagcgaactcaggggcggtatcggtttgcgcatcgaagaagtctggcccgacgaggcagccgacgtcaggattgacccgggcgtggaagtcgctcgcggtccgtttcacaacggggcgacgacaagcaacgccttcgaccctctgttcgctgacctgcgattgcaggtcaaggcccccgtgccgccatggaatgacgctacgctggaaaagcttctgcatcgcaatggcatgttcgtgatacgaaaaacagaacccggcacatacacactcgtgcggcgcaacagcgccagcaacatcgtgcaaacaagggtgcattgcaccgcagatggccggttttatatctgggaccagtcgatgcgccgcataaccggcatgatattccgcgacatcgccgcagtagccgagcgcctgatcgagctcggcatgaccctgcaaagtcgtttacccacctga

SEQ ID NO: 118 - DNA, 3135 bp, Pseudomonas Sp.
atgaccgctcccgaacgacgtctgctgccaaacgcagcggacaaaaacgccctcaaaaccatcgccacaacgatcgtgaagacctgcccgagcctgcttgatgcggcccggcaagtggccaacgaactgctcgcggacaaaggtctgtccggcctcgaccctgacgagatctatttccaccgtttcaaaacggcgcagagcagcacgcggacctttaccggttgggaacacttgctggaaaagccttacgaaacgctcaccctcacgcagctggtcatccatcgttttcgtgccaccgaccaggacaatgcagacctgctcggcctctactgcggcttttattcggatggcccgcaagcagagaatttcaatcagagcaatgaagtgcgcttgctgggcagcgacgtgctgaaggtgttttgggatgtcgacttcagcgctcgctacgccggtcaattgacgaaattctggcaaaccgcgtcggaggatttccgtgcgttggcaaagtgcaatttcctcagccaggccgtgcaggcgctgcaacagggcgacctcgatgggactgattttcagcgcatcgtcgattcggtagtcggccccgttacctggcctgtcaccctgccaatgctccgagcgacatacccggtcggcgctgaagtccgcgcgctggatctcgatggtcacgtcgccaccaatgtgctgcgtctggtagaaaccaatggtcgacagaccctctatttgcccggcgaggcccaggcctttcgcttgatggacaacgaggccgatctgcattggtggttgcttgagcagatgaatgccgaggacaagcgcccggcgtttctcaagcacttcgcgctggccgacagcaatcacctgtccgaaaacctcaccgatctgatgaatcgcctggtccacacctggggccacagcgatcaccacatggtcaaccgcagcaatgtcgcgatcagcggtgacgcattcacttggttaagcgaatcgactcgcacggcgatggttgccgaagcgcatctggtgctgacgtccaacagtgacctgcgcaagaaactctggatgggttatctgactgccggcctcaaggtgttcggccctatggcggccgtaggctggccggtggcattgcccctgattggcgccagcatcgccaacatgggtttgaacatcgatcaggccatcaacggctcgacggccaccgaacgcaaagccggcgttaccggcgcggtgctcaacgccatcgaaattgtcttcaacgtcccgttcctgatcggcacgggcgcgcaactggaggtaggtcctcaggtcgagtttgccgaagcgcaggaaatgctcgggctgatcgagttcacgtcggctgacacgcccttgctaccgcctgcagagcttccaccggccacgacgattgaagcggcgacggatgagttgacgaacgaaatcccccgcgagacgacatccgtcaccgcctctgagcacctgagcatggcggcggcaaggcaaggttcggcgttgccagggattcccggccgttatcggtgcaacgaactgcttgcacaacgttccgctgaggcggtcccgggaaaattcgaaggcatctaccgcctcgacaaagagccggcctatgccattgaaatggatggcgtagcgtattacgtgcgctattttgccgactctgaaggcactggcaactgggccatcgtcaatcccgagcgccccaatcagttcgcttactctctgccagtacgcttgggcagtggcggcaaatgggaacgtatgccagcgctgcgtctgcgtggaggcggccaatgtgtgggcaaggcgtgtttgccggaggatgaactgacctcgacgccggcttcggcaacgccgtcggcggagctgccactcgtccagccggtttcgccggttgcgcgcccgttgcgcctggtaaccccccttgacgatatcgtcgggatggacatggccagaatgagaagatgggcaatgaacttgccagagactttcgccgagctctccagtgcaaaccggggcaatcgtgcacccgccgacacgtatgcagcctatttcagcgaaagacgcgcggcactgctcaatgaagccaaggaatattactcggagctgaactggaccaatctgcccgtgcggccggtcattcctcaggtcagcccgcaaatgcagacaactcagttgatcgatcgcattttcgccaatagtcagggactggtcgtcggtgaaaccttcgatcgtatcgccagcatgcgtttcatgatcgagaacatgcccgcgttcgcgcggcatatcaaaaccctgtacgtccgtggcttgctgagtgacttcgcccaggcagatctcaatgacttctacttgtcgggagagatgtccgaggatcttcgtgtctacctgtccagcctgggtaccgaccctgaaggccggttcgacctcctcgaactggtcaagaccgcccaggccaatggcatcaggacccacggcctcgagaccgtgcacagctacaaactgaagataccgcttacctcgatcgaggagcagatgatccacgcccggctcgcctcgcagatcatgtggggtgacgaaatcctcaacggaccgggtaaatgggcagctctgatcgaggcgacgaacatcaatacgttcagaaacctgcctggaataagcgaactcaggggcggcatcggtttgcggattgaagaggtttcgccgagcgaagtggcggagacaggcatcgatccggggttgaaagtcgctcgcggtccgtttgataacggagcaacgacgcgcaactcatccgacgtgcttttcgctgatctgcgcttgcagatcgaaacagcagcgccgcaatggactgaggcatccctggaaaagcttctgcatcgcaacggtatgtttctgatcgaacaggcacaaaacaacacgtacacgttggtgcgccgcaacagcgcgagcaatattgtccggacagtggtcaatcgcaggagggatggccaggtatacatctgggcccagtcgctacctcgcatcagcggcatcatgttccgcaacatcgctgcgctggccgagcgcctgatagaaatcggcttgaccctgcaaagtcgcttgcccacctga

SEQ ID NO: 119 - DNA, 3135 bp, Meta Sp.
atgaccgctcccgaacgccgtctgctgccaaacgcagcggacaagatcgccctcaaagccatcgccacgttgatcgtgcagaactgcccgaacctgcttgatgcggcccgtcaagttgccaaggaattgctggcaggcaaaaatctgtccgcccttgatcctgacaaagtctatttccatcgtttcaaaacggcgcagagcagcatgctgacctttaccggttgggaacatgcgctggaaaagccatacgaaacgctcaccctcacccaactggtgatccatcgctttcgcacgaccgatcaagacaacgcagacctgctcggcctttactgcggcttctattcggatggtccgcaagcgcagaacttcaatcagagcaatgaagtccgactgcttggcagcgatgtgctgaaagcattctgggaagttgacttcagcacgcgctatatcgggcaattgacgaagttctggcaaacctctgcggatgatttccgtgccttggccaagtgcaatttcctcagtcaggcggtgcaggcgttgcagcagggtgaccttgatggcactgattttcagcgcgtcgtcgattcggtaatcggccccattacctggcccgtcaccctgcaaatgttgcgagccacgttcccggtcggcaccgaagtacgtgcattggatctggatagtcacgtcgctaccagtgtgctgcgctttgtcgaggacagcggccggcaaaccctctacctgccgggcgaagctcaggtctttcgcttgatggacaatgaagcggatctgcactggtggctgcttgagcagatgaattctgcggacaaacgcacggagttcctgcagcactttccgttggctgacagcaattccataacggaaaacctcaccgacctgatgaatcgcctggtgcacacctggggccacagcgatcaccacatggtcaaccgcagcaacgttgtgatcagtggtgacgcattcacttggtcaagcgagtcgacgcaccgtcgaatggtcgccgaggcgcatctggtgctgacttccaacagtgacctgcgcaagaaactctggacaggttatctgagtgctggcctgaaaatattcggcccgatggcggccgtgggctggcctgtggcgttgccgctgattggcgccggcatcgccaacatgggtctgaacatcgatcaggcgatcaacgcaacgacggttgccgaacgcagggccggtgtagtcggcgcggtgctcaacgctatcgagattgtcttcgatgtgccgttcctgatcggcaccggcgcgcaacttgaaatcggcccgcaggtcgagttcgccgaagctgaagaaatgctcgggctgatcgagttcacttcggcagatacgccaccccagcccccgctggatctggcgcccgtcacggcgattgcagaggaaaccgatgaactgacaaatgaaattgccaccgaatcgacattcatcacctccaccgagctcttgaccatgcctgctgcacggcaaggctcgtcttttccagagattcctgccaagtaccgatgcaacgagttactcgcgcaacgttccatggaggcaaccccgggaaaatatgaaggcatttatcgcctggccaaagagccaggctatgccatcgaaatggctggcaacgcgtactacgtgcgctattttgcggactccgcagatggcggcaactgggccatcgtcaatcctgaacgacccaaccagttcgcctattcgctgccggttcgtttcggtagcagcggccagtgggaacgcatgcctgcgctgcgtctgcggggaggcggccaatgcgtgggcaaggcatgtatgctggacgttgaactgacttccactccacctgcaacgacaccctcagcggagctgccattggttgagccggtttcaccggtcacgtttccgctgcgcctggttactcccctcgacgacatcgtcgggatggacatggcgcaaatgaaaagatgggcgatgaacctgcccgagacttccgtggagctacccggtgccaatcgtgaccatcgattaaccgccaatgtttatgcggcctactttcgcgaaagacgcacggtgctactgaacgaggccaaagagttttattcggaactgcaatggaccaacctgcccgcccgcccagcgattccgctaatcgatcaagagatgccaacagaaacgctgattgatcgcatcttcgctaataccaatgggctggttgtcggtgaaaccctcgatcgcatcgccagcatgcgtttcatgatcgaaaacatgcctgcgttcgcccggcatatcaaaacgctgtacgtccgtggcttgctgagtgattttgcccaggcagatctcaatgaattccatatatcgggagaaatgactgaagatcttcgaacttacctgtccagcctggggaccgaccctgatgaacgattcaacatcctagagctgatcaaagcggcccaagcaaatggcatccggactcacggccttgacgccgcgcacagttacaaactgaagataccgctcacttcgattgaagagcagatgatccacgcccggctcacctcacaaatcatgtggggtgacgatcagctcaacagaccaggcaaatgggtggcgctggtcgatgccactaacaccaacaccttccgaaatttgcccggcatcagcgaactcaggggcggcattggtttacggattgaagaagttttgcccaacgaggtggcgggcgtcagtattgatccaggtctggaagtcgctcgcggcccgtttgataacggcgcatcgacgcgcaattccttcgacgttctcttcgccgacctgagattgcaggtcgaagcaccttggccacaatggaccggggctgcacaggaaaggcttttgcatcgcaacggcatgtttctgatcgagaaaaccgaaaacaatgcatacacgctggtgcgtcgcaacagcgccagcaccattgttcgaacaacagtcaaccgagggcgagatggccagttctacatctgggctcaggcgatgcctcggatcaacggcatcatgttccgcaacatcggcgcgctggcccagcgcctgatagagatcgggctaaccctgcaaagtcgcctgccgacctga

SEQ ID NO: 120 - DNA, 3138 bp, Pseudomonas Sp.
atgacctcccccgaacgacgtctcctgccaaacgcagcggacaaaactgccctcaaagccattgccgcgactatcgtgcagacctgcccgagtctgcacgacgctgcccgtcaagtcgccaacgaaatcctggcggacaaaggactttccggccttaatcccgaccggatttacttccaccgtttcaaagcggcccagagtagtacgctgaccttcacgggttgggaacatttgctggaaaagccttacgaaacgctcaccctcacgcagttggtgatccatcgctttcgcgcgacagaccaggacaacgcagatttgcttggcctctactgcggtttctactcggatggcccggaggcggaaaacttcaatcagagcaatgaaatccggttgctgggcagcgatgtgctgaaggcgttctgggacgtcgacttcagcgcgcgctatacaggtcaactgacgacattctggcaaacctcgtcggatgacttccgcgccctggcaaagtgcaactttctcagtctggcggtgcaggcgctgcaacaaggtgaccttgatggagctgattttcagcgcatcgtcggctcggtaatcggccccgtcacctggcccgttaccttgccaatgctgcaagcgttacacccggtcggtgctgaggtgcggacgctggacctcgatggccacgtagcctccaatgcgcttcgtctggtggaagacagtggtcgccagaccctttacttgccaggcgaagcccgggcattcctcttgatggacaatcaagcggatctgcactggtggatgcttgagcagatgaattcagaggacaagcgcacggcgtttctcgagcatttcccgctggctgaccgcaatcacctgagcgaaaacctcaccgatctgatgaaccgcttggtgagcacttggggtcacagcgatcaccgcatgatcaatcgcagcaacgccgcgatcagcggtgacgcatttacctggttgagcgagtcaacacgcacgggcatggttgccgaggcgcacctggtgctcacgtccaacagtgatctgcgcaaaaaactctggatcggttatttgagtgccgggctcaaagtattcggcccgatggcagcggtgggctggcctttggcgttgcctttgattggcgccagcatcgcgaatatgggattgaacatcgatcaggccatcaacggcactacgccacccgaacgcaaggccggtgttaccggcgcagtgctcaatgccatcgacattgtgttcaacattccttttctgatcggcactggcgcgcaacttgaagtcggcccacaggtggagtttgccgaagctgaagaaatgcgcgggttgatcgagttcacttcgcctgacgcacccttcttgccgccaatggatcaaccaccagtcacggcgattgatccactggcgaacgttgagccgacaaacgaagtccccactgagactaccctcgcatccacccggcagttggccacggctgctgcgcgccaaggtgcgtcttttccaaagattcctgccaaatatcgatgcaacgagttacttgcaaaccggcctgtagaggccgcaccaggcaaatttgagggcatctatcgcctggacaaggagccaaatcatgccatcgaaatggatggcgccgcgtattacgtgcgctactttgccgactccgaagacactggcgactgggccatcgtcaatcccgagcgccccaatcagttcgcgtactcgttgccagtacgcttcggcagtagcggcaagtgggaacgcatacccgcactgcgcctcaggggaggcggccaatgcgtgggcaaggcctgtttcctggacaccgacctgtcctcgtcatcggccccggcttcatcaaccccgtcagcggagcttcccctcgtcgaaccggtttcaccggtcgcgcgaccactgcgcctggtgacgcccctcaatgacatcccaggaatggacacggcgaaaatgaaacgatgggcaatgaacttgcccgagactttcgccgagctctccagcgcaaaccgcggtaacccatcatctgccgatacgtacgcggcctattttcgcgacagacgctcgtccctgctaaacgaggccaaagagtattactcagagctgagctggaccaacctgcccgctcggcctgtcatcccgcaaatcgatgccgagatgcagacggctgaactgattgatcgcatctttgccaataccgatggactggtcgtcggcgaaacccttgatcgcatcgccagcatgcgtttcatgatcgaaaacatgccggcgttcgcacggcatatcgacacactgtacgtacgtggtttgctgggcgattttgcccaggcagatctcaacgacttttacctgtcgggagagatgtcagaggatcttcgaagctacctgtccagcctgggtaccgaccctgatggtcggttcaacatgtttgaactgatcaaggctgcccaggccaatggcatccgtccccacggtcttgaaggggcgcacagttacaagctgaaggtaccgctgacttcgatcgaagagcagatgatccacgcccggctcgcctctcaaatcatgtggggtgatgatctcctcaacagaccaggcaaatgggttgccctggtcgaagcaacgaacagcaataccttcagaaatctgccaggcatcagcgaaatcaggggcggcatcggtttacgcattgaagaagcgacgtccaccgaagtgcccggcatcagaatcgacccgggactggaagtcgctagagggccgtttgataacggggcatcgacgcgcaactcatccgactttctattcgcggatctgcgcttgcagatcgaaacacctgtgccgcagtggactgaggcaacggtgaatacactgctgaatcgcaacggcatgttcatgctcgaaaaaacgcagaatgcatacacgcttgtgcgtcgcaacagcgacggcaatattgttcgaacaatggtgaatcgccgaggggatggtcaggtttacatctgggcacagtcgatgccgcggatcagcggcatcatgttccgtgacataggcgcgttatcccagcgcctgatagagatcggcttgaccctgcaaagtcgcttgcccggctaa

SEQ ID NO: 121 - DNA, 3147 bp, Pseudomonas Sp.
atgacctcccccgaacgacgtctgctgccaaacgcagcggacaaaactgccctcaaagccattgccacgacgatcgtgcagacctgcccgagtctgttcgacgcagcccggcaagtcgccaacgaactcctggcggacaaaggcctgtccgacctcgatcccgaccggatttacttccaccgtttcaaaacggcgcagagcagcgcgctgaccttcacgggctgggaacatttgctcgaaaagccttacgaaacgctcaccctcacgcagttggtgatccaccgctttcgtgcgaccgatcaagacaacgcagatctgcttggcctttactgcggcttctactcggatggcccggaggcggaaaacttcaatcagagcaacgaagtacggttgcttggcagcgatgtgctgaaagcgttctgggacgtcgacttcagcgcgcgctacacaggtcaactgacgacattctggcaaacctcgtcggataacttccgcgccctggccaagtgcaactttctcagcctggcggcgcaggcgctgcaacagggcgaccttgacggaactgattttcagcgcgtcgtcggctcggttatcgggcccgtcacctggcccgttaccttgcaaatgctgcaagcgttacacccggtcggcgctgaagtgcgggcgctggatctcgatggccacgtagcctccaatgcgctgcgcctggtggaagacagtggcaggcagaccctttacttgccaggcgaagcccaggcattcctcttgatggacaatgaaacggatctgcacttgtggatgcttgagcagatgaattcagaggacaagcgcacggcgtttctccagcacttcccgctggctgaccgcaatcacatgaccgaaaacctcaccgatctgatgaaccgactggtgagctcctggggacacagcgatcaccgaatgatcaatcacagcaacgtcgcgatcaccggtgacgcattcacctggttgagcgagtcgacacgcacgagcatggttgccgaggcgcatctggcgctcacgtccaacagtgacctgcgcaaaaaactctggatcggttatttgagtgccggtctgaaagtgttcggcccgatggcagctgtgggctggcctttggcgttgcctttgattggcgcgagcatcgcgaacatgggcttgaacatcgatcaggccatcaacggcaatacgccaaccgaacgcaaagccggtgtcaccggcgcagtgctcaacgcgatcgacattgtgttcaacatcccgtttctgatcagcactggcccacacctggaagtgggcccgcaggtggagtttgctgaagcggaagaaatgcgcgggttgatcgagctcacttcggccgaaacacccttcttgccacctctggctccaccgacggtcacggcggtcacggcggttgagccagaggcggccgtcgagctgactaacgaaatccccatcgagacgaccatcgcatccacccgggagctggccacggctgctgcgcgccaaggttcgtcttttccaaagattcctgccagatatcgatgcaacgagttactggcacagcgttctgtagaggcagctccaggcaaatatgagggtatttaccgcttggacaaggagccggcctttgccatcgaactggatggcgacgcgtactacgtgcgctactttggcgactccgaagacaccggcaactgggccatcgtcaatcctgagcgacccaatcagttcgtgtactcattgccagtacgcttgggcagtagcggcaagtgggaacgcatgcccgcgtcgcgtctcaggggcggcggccaatgcatgggcaaggcgtgtttcctggacactgacctggcctcgtcctcggccccggcatcagcaacgccgtcagcggaacttcccgtcgtcgaaacggttccacccgctgcgcgaccgctgcgtctggtttctcccctcacccacatcgtgggaatagacatggcgaaaatgaaaagatgggcaatgaacttgcccgagactgtcgccgggcgctccggtgcaattcgcgctaatccatcagctaccgatgcgtatgaggtctattgccgcgacaggcgcacgtccatgctgaacgaggccaaagagtattactcagagctggactggaccaacctgcccgtaaggccagtcatcccgcaaatcgatcccgagatgcagacggatgaattgtttgatcgcatctttgccaataccgatggactggtcgtcggcgaaacccttgatcgcatcgccagcatgcggttcatgatcgaaaacatgccggcgctctcacggcatatcgacacactgtacgtacgcggtttgctgggtgatttcgcccaggcagacctcaacgacttttacctgtcgggagagatgtcagaggatcttcggggctacttgtccagcctgggtaccgaccctgacggccgattcaacatgctagaactgatcaaggctgcccgggccaatggcatccggacccatggtcttgacgccgcgtacagttacaagttgaagataccgctgacttcgatcgaagagcagatgatccgcgcccggctcaccactcagatcatgtggggtgacgggctcctcaaccgaccaggcaaatgggctgccctggtcgatgcaacgaacaccaataccttcagaaatctgccaggcataagcgaactcagaggcgggattggtttacggattgaagaagtgacgtccaccgaagtggccggcggcagtatcgacgcgggactggaaatcactcggggcccgtttagtaacggagcatcggcgcgagactcattcgacattctatttgctgatttgcgctggaagatcgcgacacctgtgccgcaatggactgacgcaacggtgaatacactgctgaatcgcaacggcatgttcatgttagaaaaaacgcaaaatgtatacacgctcgtgcgtcgcaacagctccggcaatattgttcgaacaacagtgtatcgccgaagggatggtcaggtttacatctggacactgtcgatgccccggatcagtgccatcatgttccgtgacatcgccgcgttatcccagcgcctgatagagatcggctttaccctgcaaagtcgcatacccgcctga

SEQ ID NO: 122 - DNA, 3120 bp, Pseudomonas Sp.
atgaccgctcccgaacgccgtctgctgcccaacgcagcagacaaaaccgctctgaaagccctcgccacgacgatcgtgcagacctgcccgggtctgtttgacgccgcgcgtcaggttgccagcgaactgctggtggctaaaggtctgtccggcctcgatcccgaccgggtgtatttccaccgtttcaaaaccgcgcagagcagcgcgctgacctttaccggttgggaacatttgctggaaaagccctatgaaacgctgaccctcacccaactggtgatccatcgctttcgcgcgaccgatcaagacaacgccgacctgctcggcctctacgctggcttttattcggagggtccgaccgccgagaacttcaatcaaaacaacgaagtgcgcttgcttggcagcgaagttctgaacgtgttctgggaagtcgatttcagtaagcgctacaccgagcaattgagcaagttctggcaaacctcatcgaatgactttcgcgtcctggcgaagtgcagtttcctcagtcaggcggtgcaggcgctgcaacagaatgatcttggtggcgaggattttcagcgcattatcgcttcggtgatcgggcccattacttggcccgttactctgcaagtgctgcgagcgacctacccggttggcgcagaagtacgtgcgctggatctcgatggccacgtcgctaccgatgtgctgcgtctggtcgaagacagcggccggcagaccctttacttgccaggcgaagccccggcttttcgcctgatggacaccgaggcggatctgcacgggtggctgcttgagcagatgaatgccgaggacaaacgcagtgcgttcctcaagcatttcccgctcgccgagagtcaccgcatcagcgaaaaccttaccgatctgatgaaccgcctggtgagtacctggggccatagcgatcaccagatgatcaatcgcagcaacgtcgccgtcaccggggacgcgttcacctggttaagcgaatcgacacgcagcgccatggtcgccgaggcacagctggtgctgacctccaacagtgacctgcgcaaaaaactctggataggctatctgagcgcaggcctgaaagtattcggcccgatggcggcagtgggttggcctgcggcgttgccgttgatcggcgcgagcatcgccaacatggggctgaacatcgatcaggccgtcaacggcaccacagccgccgaacgcagaacgggtcttgccaatgcggtgctcaacggtattgaaattgtcttgaatgtgccgtttctgatcggcacgggcgcgcagctggaagtcggcccgcaggtcgagtttgccgaagccgaagaaatggccgggttgatcgagttcacttcggcgaacacgcctctgctgccccccgcggagccgccgccagccacggtaattgaagaagccagcaatgagttggcaaacgacattcccatcaatacgcccccggccacacccgcctcgacctccacgactgccgctgcccccgtgcccggcattcctgcccgctaccgatgcaacgaggtactggtaccggacgccgtacaggcggccccagggaaatttgaaggtatctaccgtctcgacaaggagccacgctacgcgatcaaaattggcgacgaggcgtattacgtgcgctactttgacgactccgagcagagcggccactgggcgatcgtcaatcccgagcgccccaatcagttcgcgtattcgctgcccgtacgcttgggtgctggcggcaagtgggagcgcctacctgcattgcgactcaagggcggcggtcaatgcatgggcaaggcttgcataccggacgctgacacgacttccgagccgtcttccacaacgcccacgccggagctgccgctggtcgaaccggttcccccgtctgcccgtccgctgcgtctggttacgcctcttcacgaggtgatggggatggatatgccggcactcaggagatgggcgctgaacctgcctgacacctccgctacgctgcccggtggcggccacgacaatcgatccgttgccgaggcgtttgccagctacttcagcgaaagacgtgccagtctgctcaacgaggccaaggagttctactcggaactgagctgggccaacctgcccccacggccagtcatccctcaggtcactccggcgatgccgacgggcgagctgatcgacagcattttcgccaacagcaatgggctggtgattggcgagacgctggatcgcatcgccagcatgcgcttcatgatcgaaaacatgccggcgttcgcacggcacatcaacatgctgtatgtccgtggactgctcagtgattttgctcagacggatctcaacgagttcttcctgtcgggagagatgtcgcaggacctgcgtacctatctgaccagccttggcaccgaccccaatgagaggtttaacgtccttgagctggtaaagaccgcccaaaccaatggcatccgggtccagggccttgatgttgcgcagaactacaagccgaaggtgccgctcacctcgatcgaagaacagcttatgcgcattcgcctgagcagccggatcataaggagtgacgccattctcaacagaccgggcaaatgggttgccttgagcgaggcaaccgataccaatacgttcagaaatctgccgggaataagcgaacacatgggcggcatcggtttacggatcgaggaggtttcgtccgcagaggaagcaggcgtcagtatcgatcccggtctggacgtcgcgcgtggcccgtttgataacggcgcatcgacccgcgcttcggtcgatgtgctctacgcagacctgcgtttgcaaatcgaatcacccttgccgcagtggacgcctgccgcgcaggaaaagctgctgcatcgccatggcatgtttctgttcgaaaaaaaccagaatgcctacaccctgatacgtcgcgacagctcaggcaacatcgtgcgaacagcggtgaatagccgaagggacggccaggtctacatttgggcccagtcgatgcctcgaatcagcggcatcatgttccgcgacctcgccgcgctatcccagcgcctgattgagatcggcctgaccctgcaaagccgcctgcctacctga

SEQ ID NO: 123 - DNA, 3132 bp, Pseudomonas Sp.
atgaccgctcccgaacgccgtctgctgcccaacgcagcagacaaaaccgccctcaaagccctcgccacgaccatcgtgcagacctgcccgggtctgtttgaagccgcacgtcaagtcgccagcgaactgctggtggccaaaggtctgtccggccttgatcccgaccgggtgtatttccaccgtttcaaagccgcgcagagcaacgcgctgacctttaccggttgggaacatttgctggaaaagccctatgaaacgctgaccctcacccaactggttatccatcgctttcgcgcgaccgatcaagacaacgccgacctgctcggcctctactgcgggttttattcggaggggccgaacgtcgagaatttcaatcaggacaatgaagtgcgcttgctgggcagtgatgttctgaaggtgttctgggaagtcgacttcagcacgcgctacagcgagcaattgagtaagttctggcaaacctcggcggatgattttcgtgttctgagcaagtgcaacttcctcagtcaggcggtgcaggcgctacaacagaatgatcttgaaggcgatgattttcagcgtattgttgcttcggtcatcgggccgatcacctggcccgttactctgcaaatgctgcgagcgacctacccggtcggcgcagaagtacgcgcgctggatctcgatggccacgtcgctaccgatgtgctgcgtctggtcgaagacagcggccggcagaccctttacttgccgggtgaagccccggcttttcgcctgatggacagtgaggccaatctgcactggtggctgcttgagcagatgaatgccgaggacaaacgcagcgcatttctcaagcatttccctctcgccgagagtcaccgcatcagcgaaaaccttaccgatttgatgaaccgtctggtgagcgcctggggccatagcaatcaccagatgatcaatcgcagcaacgtcgccgtcgccggtgatgcgttcacttggttaagcgaatcgacacacagcgccatggtcgccgaggcacagctggcgctgacctccaacagcgacctgcgcaaaaaactctggataggttatttgagcgcgggtttgaaagtattcggcccgatggcagcggtgggttggccggcagcgttgccgttgatcggtgccagcatcgccaacatgggtctgaacatcgatcaggccgtcaacggcaccacagccgccgaacgtaaaacgggccttgccaatgcagtgctcaacggtatcgaaattgtgctggatgtgccgtttctgatcggcactggcgcgcagctggaagtcggcccgcaagtcgagtttgccgaagccgaagaaatggccgggttggtcgagttcacttcggcgaacacgcctctcctgccgcctgtagagccgcccccagccacgctggttgaagaagccagcaccgaattggccaacgacattcccatcgaaacgccttccgccacatccgtccaggcctcgacgactgccgctgcacaacagggaccctccgtgccggggattcccgcccgctatcggtgcaacgaggtacttgtatcggacgccgttgagtcggcccctgggaaatttgaaggtatctaccgtctcgacaaggagccacgctacgcgatcagaatcgatgacgacgcgtactacgtgcactactttgccgattccgaggagagcggccactgggcggtcgtcaatcccgagcgtcccaatcagttcgcttattcgctgccggtacgcttcggggctggcggcaaatgggagcgcatccctgcgttgcggctcaggggcggcggtcaatgtgtgggcaagtcgtgcacattggatattgaaacgacgcccgagccgtccacgacaacgccctcggcggagctgcatttggtcgaaccggttcccgggtctgctcgtccgctgcgtctggtgacgcccctccacgacgtcatggggatggacatggcagcgctaaaaagatgggcgatgaatctgcctgaaaccttcgctacgctgcccagcgccgctcacggcaatcggccgattgctgaggtgtttgccgcctacttcgggcaaaggcgcgccattctactcaacgaggccaaggaattttactcagagctgaactggaccaacctgcccgcccggccgatcatcccgccgattacctcagcgatgacgacagacgaagtgatcgacggtatttttgccaacagcagggggctagtgattggcgagacgctggatcgcatcactagcatggggttcatgatcgaaaacatgccgctgttcgcacggcacatcgataccctttacgtgcgtggattgctcagtgattttgctcagactgatctcaacgactttcacatgtcgggagagatgtcacaggatctgcgtacctatctgtccagccttggcaccgaccccgatgaccggttcaacgtcctcgagctggtcaggaccgcgcaggccaacggcgtccgggttcacggcctcgacgtggcgcaaaattacaaaccgaaggtacccctcacctcgattgaagagcagatgatgcacgctcgcctgaccacccgaatcatgtggggtgacgaaatcctcaacaaaccgggcaaatgggttgtattgagcgaagcaacgaataccaataacttcagaaacctgccgggcatcagcgaacacatgggcggcatcggtttacggatcgaggaggtgtcatccgccgaggaagcaggcgtcagtatcgatcccgggctggaaatcgcgcgcggcccgtttgacaacggcgcaacgacccgtgcctcagtcgacgtgctctacgctgacctgcgtttgcagatcgaatcagctacgccgcaatggacacccgcggcgcaggaaaagctgctgcatcgcaatggcatgtttctgatcgaaaagagccaaaacgcctacacactggtacgtcgcgacagctcaagcaacattgtgcgaacaacggtcaatcgcagaagggatggccaggtttacatatgggcgcagtcgttgcctcgaatcagcggcatcatgttccgtgacatcgccgcgttatcccagcggctgatagagatcggcctgaccctgcaaagtcgcctgcccacctga

SEQ ID NO: 124 - DNA, 1305 bp, Proteus Sp.
atgtcatctacacttaagcttaatgatggtttatctgatatcggttcgataatacattatggtatcagtcagatcccagtaatcgggggtgtactaagcaccatttttggccttttatggccaacagacaaggaagatatatggagtacgattaaacaggaagtgcaaagccttattaatgaagatattcaagaggacgactggaaccgccttgtggccgcagtaaacgagcttcaggataaagtatcatttatcaatgaccagttaattaatgcccagtatgatactgcgggccctgaactgatgacagtggttgtagatataattggaattgaagaaaacttcaaaatagaagggactaatttcaaatatgcatttgctccactttttgtcgctgctgtgaatttaaaaattgccttatatcttgaagggattaaatactctaatgatttaggattaagtcaagatcaagttaatcaattaaagtcattgcttcaaaaagatgttcaaagctccaagagttatttatctccgataaattcggcaataggcaatacttatcttaacaacatacagacctactttagtgttaagttatattatgaaacaagcgtgtctttatttaatgaactatggtcaggggattatgaagactataatgcgcctgcaccgctggaaaattactacgttccagtcatggcagctggatctttctataagcttataagcctagacgggcaaaatttctcagtgcctatggcatttgctgaagtagctgataactcaatgatgccttctacaaacatcctgggatctttatatcaggagccaacatcttatccagacggctatattaattttattgatgtttataccgacctgtcagtgtcacatcgaactactgggttaatgtttacctgtagtggatctgatgaacaatatgaaatgggtatgacgccaaataacaattactcattcaatgttggacaaaacactatgagtattaatgttgagggtggtgagttcattaatcaggtatccgtgagagcggactcttttgtttcacaaattgagttcaccactaatcttaataatacaatggtagcaggtcagcatcctgatgatgaccctatacaagaagtcactttagtcagcccattttcaattaactccatgtatgtggtctctgatgttgcaggatatatacaatcatctggccatcaaatgtgtgggatagcgatttcagcaatatataataatgaacttgcgatgcaatatgtcagcagcctatataaaaacagttaa

SEQ ID NO: 125 - DNA, 1305 bp, Proteus Sp.
atgtcatctacacttaagcttaatgatggtttatctgatatcggagcgataatacattatggtatcagtcagatcccagtggtcggaggtgtactaagcaccatttttggccttttatggccaacagataaggaagatatatggagcacgattaaacaggaagtgcaaagccttattaatgaagatattcaagaggacgactggaatcgccttgtggccgcagtaagcgagcttcaggataaagtatcatttatcaatgaccagttaattaatgcccagtatgataccgctggccctgaactgatgacagtggttgtagatctcgttggaattgaagaaaacttcaaaatagaagggactaatttcaaatatgcatttgctccactttttgtcgccgctgtaaatttaaaaattgccttatatcttgaagggattaaatactctaatgaattaggattaagtcaggatcaagttaatcaattaaagtcattgcttcaatctgatattcagaactccaagagttatttatctccaataaattcggcaataggcagtacttatcttaacaacatacagacctactttagtgttaagttatattatgaaacaagcgtgtctttatttaatgaactatggtcaggggattatgaagactataatgctcctgcaccgctggaaaattactacgttccagtcatggcagctggatctttctataagcttataagcctagacgggcaaaattactcagtgcctatggcatttgctgaagtcgctgataactcaatgatgccatctacaaacatcctgggatctttatatcaggagccaacatcttatccagatggctatattaattttatcgatgtttatacagacctgtcagtgtcacatcgaactactgggttaatgtttacctgtagtggatctgatgaacaatatgaaatgggtatgacgccaaataacaattactcattcaatgttggacaaaacaccatgagtattaatgttgatggtggtgagttcattaatcaggtgtccgtgagagcagaatcttttgtttcacaaattgagttcaccactaatcttaataatacaatggtagcaggtcagcatcctgatgatgaccctgtgcaagaagtcactttagtcagcccattttcaattaactccatgtatgtggtctctgatgttgcaggatatatacaatcatctggccatcaaatgtgtgggatagcgatttcagcaatatataataatgaacttgcgatgcaatatgtcagcagtctatataaaaacagttaa

SEQ ID NO: 126 - DNA, 1305 bp, Klebsiella Sp.
atgtcatccacacttaagcttaatgatggtttatctgatatcggtgcgataatgcattatggtatcagtcagattcctgtggtcggaggtgtactaaacaccatttttggccttttatggccaacaaataaggaagatatatggagcacgattaaacaggaagtgcaaagccttattaatgaagatattcaagaggacgactggaatcgccttgcggccgcagtaagcgagcttcaggataaagtatcatttatcaatgaccagttaattaatgcccagtatgatactgctggccctgaactgatgacagtggttgtagatatagttggaattgaagaaaacttcaaaatagaagggaccaatttcaaatatgcatttgctccacttttcgtcgccactgtgaatttaaaaattgccttatatcttgaagggattaaatactctaatgaattaggattaagtcaagatcaagttaatcaattaaagtcattgcttcaatctgatgtgcaaagatccaagagttatttgtctccaataaattcggcaataggcagtacttatcttaacaacatacagacctactttagtgttaagttatattatgaaacaagtgtgtctttatttaatgaactatggtcaggtgattatgaagactataatgctcctgcaccgctggaaaattactacgttccagtcatggcagctggatctttctataagcttatgagcctcgacgggcaaaaattttcagtgcctatggcatttgctgaagtagctgataactcaatgatgccttctacaaacatccagggctctttataccaggagccaacatcttatcccgatggatatattaattttatcgatgtttatacagacctgtcagtatcacatcgaactactgggttaatgtttacctgtagtgggtctgatgaacaatatgaaatgggtatgacgccaaataacaattactcattcaatgtcggacaaaacaccatgagtattaatgttgatggtggtgagttcattaatcaggtgtccgtgcgggcggaatcttttgtttcacaaattgagttcaccactaatcttaataatacaatggtagcaggtcagaatcctgatgatgactctatgcaagaagttactttagtcagcccattttcaattaactccatgtatgtggtctctgatgttgcaggatatatgcaatcatctggacatcaaatgtgtggggtggcgatttcagcaatatataataatgaacttgcgatgcaatatgtcagcagtctatataaaaacagttaa

SEQ ID NO: 127 - DNA, 303 bp, Proteus Sp.
atgtcgactaattatgttattcaacctttggaaacagttacagtatgggacgatgctgagcctatcattccaacagttactaaaagtgtaattgtgactaataatggtgaaacgaaattagaagttgtgaattactgggcaccaccgtcacatgttttttatcccgataccacatattgggttgaacccaatgacacgattatcgttcaagcacccgaacgatcattttactactacagagttaatgtaactaactcggatgctaccaaggtgggtgcggctatcgttgaaattgtagattag

SEQ ID NO: 128 - DNA, 303 bp, Klebsiella Sp.
atgtcgactaattatgttattcaacctttggaaacagttacagtatgggacgatgctgagcctatcattccaacagttactaaaagtgtaattgttactaataacggtgaaacgaaattagaagttgtgaattactgggcaccgccatcacatgttttttatcccgataccacatattgggttgaacccaatgacacgattatcgttcaagcaccccaacaatcattttactactacagagttaatgtaactaactcagataataccaaggttggtgcggctatcgttgaaattttagattag

SEQ ID NO: 129 - DNA, 306 bp, Proteus Sp.
atgtcgactactaattatgttattcaacccttggaaactgttacagtatgggacgatgctgagcctatcattccaacagttactaaaagtgtaattgttactaataatggtgaaacgaaattagaagttgtgaattactgggcaccgccatcacatgttttttatcccgataccacatattgggttgaaccctatgacacgattatcgttcaagccccccaacgatcattttactactacagagttaatgtaactaactcggatgataccaaggtgggtgcggctattgttgaaattttagattag

SEQ ID NO: 130 - DNA, 4461 bp, Serratia Sp.
atggctgagatctgggcagcaagaaaggatgacgaactgatccacaccagcgcgttggcggacatcgccagcgccgtcgcggaagtcgcggtatatgcggtagcgaccgccgccgtgtccgcagccgccgccgccgcagcgccggcattggcaggggtggcggtgctcggcgcagcggcgacggcggcctccggctgcgtcggcgccgggctaatcgtcggttttgccaccagcctgaccggcgtcggagaacatatcagcaacggctgcgacgccgtggccaactggctcttcccgccttccgtctccggcgtcattctcacgggctcccccaacgtcttcaccaacgccaaaccggcggcacgcgccgccggtcgcttactcacgcccgcagagatcaaagcgttaccggcgccacagccgccgcaaagcttctgggattatggcgccgagctgctggccgccggcggtaatatcctctcgcagctatggcagcccggtgtcgccggccccagccagcccagccaaccgctggaagaagataaaatcagctgcgacaaacacccgcttccgcaatacctggcggaaggctcccgtaaagtatttatcaacggccaaccggccgtacgcagcaatgaccgttcaacctgcgaggcgaaagtctcgaccgacgtctccaaaaatgtgcagatcggcggcgacacggcggtggtacgcgacatcaagagcggcaagctgccgggtatcggtttggcgctgaccgtgctgccgctgctgctcggtaatccggccaagctggttaagaacctgccttgcatgatcggcggcggtctggcggcggcgggcgttaacgccctcggcgaagcgatccacgccgcctttaacccggtgcatgccgccaccggcgccaaggtattgaacggcgaagaagatctggacctgttgctgccggcgcgctttccgctggtctggcagcgcaattacaacagccgcaatggctatcagggactgtttggccacggctggcgcacgccttttgaaatttgggtcgatcttaacgaccgggacggcgtcgttgagtgttgcctgcatgatgaaaccggtcgtgagctactcttcccgctgcctgaggtgaaccagccgagcttcagcgccggtgaagggctgatgttccgccgcggtgaagagggacagctgctgatcgccgacaccgacggcagcgtctggcgcctgttcgtgccgctgccgcagaacccttcccgcctgcggctagtgtcgttgagcgatgagtacgataacgcgctgctgctgaactacgacgaacgacagcgcctgagcagtatcaccgatagcgccggcgccatgacattgcggctggaatacggcgatccgcgcttcgacgatcgcgtcaccgccttgcggcataacgacgaagcacgcgtacgctaccgttatgacgacggcggcgatctgcatcaggtgatcgacgccggcggcttggtcacgcgtgaatttcactataacgcccaacatctgttgacccgccaccaacaggccggtgggcccagcttcgagtatcgctgggcgatgttcgacgactggcgcgtggtggaacaccgcgacagcgccggcggcggctgcacaatcgactacgatttggccaccgggttaacgacggtcaccgagtatgacggcttgcggcaccagcaccgctggaacgcccaacggctgatcgtcgaatataccgacgagcgtggtgaggtctggcattatcaatggaatgacgaagacatgctgatcgccacgcgcgatccgctcggccacggctggcatttccgctacgatgaagccggcaatctggtcgaggaagaggatccgctcggccatattcgcctcaccggttggctaccgcagcgcgcgctgccgatcagcgtcaaggagcccaacggcgccacacagcatttctactacgacgagcgccatgccttgattgccgagatcgatgcgctcggccatacccagcgctacctgcgcgatggctatggccaggtggtgcaagccgtcgacgccaacggcggcatcagccatttcgcttatgatgagcacgggcaattattgcgcgcccgcgattgctccggcaaacaaaccctctacaaatatacggctcaaggctggctcagcgaggtaaccgacgccgccggcgaacgcgttcattaccgctacgatgccgccggtcgcctgacacagctgcagcgcgccgagggctggcaagagacgctgagctggaacgcgcagggccagttggatcgctatcagggggccaatgggcgcctgacgcattatcgctatgacgcagccggccgcctgctggccacgcgcaatccgctcgatggcgaggtggtgcgccactacgacgcccgcggcagattaacggcgctgcgcaacgagaatgccgaaagctacctgttccattggacggcctgcaacttgttgcaggaagaaatcggattggacggcgtcagcacccgttatcgttacgacgaatgccgccgggtcgtcgagcgccgcttcgccgccaatacctccgcctccttctcgcactatttcagccatgacgccgccggccaactggtgagcaaacaaacgcccgatggagaaacccgctaccgctacagcccgatcggccaactgctgcatgccgccagtgaccgcggcaacgcatggcatgacgagccgacaacggctcagagcgaggtcagttttgactatgacttgctggggcgggtaacccgtgaacaaggtgccaacggtacgctgcgctatgattacgatccgatgggtaaccgcacgcaaaccacattgcccgacggacgcgcgctgcgcgcgctgtactatggcagcggccacctgctgcagctggcgctggacgatatcaccctcagcgagttcgaacgcgacaatctgcaccgcgagctgagccgtacgcagggtcgcctgaccagccgagtgcattatgaccggctggggcgcaaagaccggcgggagatcttcaatgacaaccgccagcgcccggcgccggccagcagctcgcgccaatggacctacgactatcaaaacaacctgacgcgcgaagaacacaacgccaacccgttctcctaccagcgttatcagtacgatgcctccggtcgattgctgaaccgggacggcacgctgccggataccgagcgctaccggtacgatccggcatccaacctgctggatgaggggcaattccgccagcggcacaaccgcgtactgcattatcagggcgttgattatcggtacgatgtctttggccgcacggtggaaaaacgcaaaggccactaccgttggcaatatctctacgacgccgatcatcgcctctgcgaggtggtgcgctacagccagcatcgcagcgaagcacagcagcatgtgcagttccactatgatccgctcgggcggcgcacgcaaaagcgggtgtggcagcaaagtcaggatctgcgccaaccggccggcaaatgccaaaccaccacgtttttgtgggaaggtttccggctgctgcaggaaactcgcgacggcatgcccctcacctatgtctatgccgatcagggcagctatgaacctttggcgcgcatcgacggccacgcgccggcccaagtattttacttccacacggcgccgaacggcgaaccggaaagcctgaccgacagcgacggaacgctacgctggcagagccacagcagcgcctggggccgcataaagtatgaggaaaatcagcaagatctggattactcccaaaacctgcgcctgcagggtcaatacctggatcgggaaacgggattgcactacaatttgttccgctattacgatccggatatcggcagatttacccagcacgatccgataggtttggccggcgggatcaacctgtaccaatacgcgccgaacccgctgggttgggtggatccgttggggttgagttgcggcaattcctggaataattttcaatcgaagtcgaaaggtgtttttgcatccagaagccaggcatctaaagcttataatctgtggaaaaaacaagattgggcggccttagaaaaattcatggggcatggctcatggcctcccaatagaggttttgtacaagcaacgcctactactcttatgcctggagcaaaaattgatagatacggtggctggacaaataatggcgtattcaacgaccgaggtacctttgtctctcctgctggagcctcttttggcagccgggcattaccgttagatacactggaaaaaccgtatcgagtatatgaggtggttaaaccaatccaagcagatatggggcctgctataccgtggtttaaccaagctggtggaggaacacaatttgaactgtccaaatccatcagtcaacttcttgcagaaggccgaatccggccaatttga

SEQ ID NO: 131 - DNA, 4407 bp, Serratia Sp.
atgagcgatatttgggcggcaagaaaggatgacgaactgatccataccagcccgctggcggacatcgccagcgccgttgccgaggtcgcggtttactcactggcgacagccgccgttgcggccgcagcggcagcggcagctccggcactggcgggtgtggcggtgttgggtgcggcggcaacagcggcctccggctgtgtcggtgccggtctgatcgtcggcttcaccgccagcctgaccggcgtcggcgaacatatcagcaacggttgtgacaccgtggccaactggctgtttcccccggtggtctccggcgtgatcctcacaggatcggccaatgtgttcactaacgccaaaccggccgctcgtgccgccgggcggttgctcacagctgatgagatcaaagccctgcccgggccgcaaccgccacaaagtttttgggattacggttctgagctgctggccgccgggggcaatatcatttcccagttgtggcagcccagcgtcgccggtcccagcctgcccagccaggcgctggaagaagacaagatcgcttgcgacaagcaccccagcccgcaatatctggcggaaggttctggcaaggtattcattaacggtcaaccagccgtgcgcagtaacgaccgttcaacctgtgaagccaaggtctcgaccgacgtttcaaagaacgtcctgatcggcggcgatgcagttgtggtgcgggatatcaaaagcggcaaactgccaggcatcggcctggcgctgaccgtactgccattgctgctcggcaacccgtccaaactggtcaagaacctgccctgcatgattggcggcgggctggcggcggcaggtgccaatgcgcttggggaagcgatccacgccgcgtttaatccagtacacgctgccaccggtgccaaggtcctgaacggcgaagaggatatcgatctgctgctgtcggcgcgcttcccactggtctggcagcgtaattacaacagccgtaaccgctatcagggcctgttcggtcacggctggcgtacaccgtttgaaacctgggtcgatctggctgacgacggcaaaggcggtgtcgaatgctgcctgcatgatgaaaccggccgcgaactgcgcttcccgctacccgaggtgaacaaacccagcttcaacgccggtgaaggtttaatgttccgcagcggcgaagaaggtcaactggtcatcgccgataccgatggcagcgtgtggcgactgtttgtcccgctgccacaggagccctctcgcctgcggctaatgtcgctgagcgacgaatatgacaacgcgctgctgttgagctacgacaaacagcaacgcctgagccagatcagcgacagtgccaacgccatgacgttggcactggaatacgccgatgctcgctttgccgatcgcgttacggcactgtgccataaccagcagacacgggtacgctattgctataacgacaccggcgatcttcaccaggtggttgacgccggtggcctgattacccgcgagttccattataacgatcagtctctgttgacccgccatcagcaggtgggcggcccctatttcgaatatcgctgggcgatgtttgacgactggcgggtggtggaacaccgcgatgaagccggtggcggctgcaccatagattacgatttggcggcaggcctgaccaccgtcaccgaatacgatggtctgcaacacagccaccgctggaacagccagcagttgattaccgaatacaccgacgagcgcggtgaagtctggcgctaccagtggaacgacgaagatatgctggtcgcgagccaggatccgttgggccatggctggcaatttcgctacgacgaagccggtaacctggtcgaagaacaagatcctctcggcaatatccgcctgacacaatggctgccacagcgcgcgctgccggtcagtatcaaagcacctaacggtggcacacagtatttttattacgatcagcgccacgcgctggtagccgacgtcgatgcactcggtcacacccagcgttatttgcgcgatgactacggccaggtcgtacagtcggtcgacgccaacggcggcatcagccatttcgcctatgacgaacacggccagttgatccgcgcccgcgattgttcaggtaaacagaccacctacagctacctgccacaaggctggttaaccgaggtcaccgatgccgccggtgagagcacccgttaccattacgataacgtcggccgcctgacacagttgcagcgtgccgaaggctggcaggagaaactgggctggaacgcacagggtcagctggtgcattaccagggggccgatggtcgcctgacacattaccgttacgacagcgtcggccgcctgctggccacccgcaacccgctcgatggcgaagtgctgcgcagctacgatactcgtggtcggctgaccgccctgcgcaatgagaacggcgagagctactgcttccagtggacagcggccaacctgctgcaggaagagaccgggctggacggtatcagtacccgctatcgttatgacgagtgccgtcgggttattgagcgcatctttgcagccaatacgcctgctgccttttcacactacttcagccatgacgccgccggacaactgttgaacaagcagacaccggacggagaaacccgctatcgctacaatccggtcggccagttactgcacgccgccttctatcgcggcgatgtatggcgggattttcagccggaagcggagagcgaagccagcttcagctatgacctgttgggtcgggtgctcagtgagcaaggtaatcagggcacgctgaactacgattacgacccgatgggcaaccgcacgcaaattgctctgcccgacggccgcaccctgcgttcgctgtactacggcagcggccacctgctgcaggtggcgctggatgacgttaccattagcgagttcgagcgtgacaacctgcaccgtgagttgagccgcacccagggccgactgaccagccggctgcactacgatcggctcggccgcaaagatcgccgggagatttttcacgacaatcgccaacgtccggcccctgccagcagttcgcggcagtggttctacgactatcaaaataacctgacgcgcgaagaacagaacgccaacccgttcgcctatcagcgttatcactatgacgccgcaggccgtctgctaagccaggacggcaccttgccagacaccgagcgctaccgctacgatccggcctccaacctgttggatgaggggcaattccgccagcggcataaccgcgttatgcactatcaaggcatcgattaccgttacgatacctttggccgcacggtggaaaaacgcaagggtcactaccgctggcagtaccattacgacgccgaacaccgactctgcgaagtggtacgttacagcctgcaccgcagcgaacccttgcagcatatgcagttccgttacgatccactcggacggcgcacgcaaaaacaggtatggatgcaaagccaggacctgcgccaaccgggcggaaaacgccagaccaccaccttcctgtgggaaggtttccgactgttgcaggaaacccgcgacggcatgccgctcacctatgtgtatgccgatcagggaagctatgagccactggcacgtatcgacggcgggccgcaggcgcaggtgttttacttccacaccgcgcccaacggcgaaccggaaagcctgaccgacagcgacggtaccctacgctggcaaggccacagcagcgcctggggcaaaacaaagtatgaagaaaatcagcagcatctggattactcccaaaacctgcgccttcagggccaatatctggatcgcgaaaccggattgcactacaatctgttccgttattacgacccggatatcggcagatttacccagcacgacccgattggtttggcgggtgggataaacctttatcagtatgcgccgaaccctttggggtgggtggatccgctgggtttgagccgtacatgtaaagatccctcgaaagacgcgactcagtggcaagggccgcataatcgtgattatcctgggatagatacttataacaacaggacacttaaaaagggcacaatattgtatgccttgcatccaaatggagatcaactacctccttacacagtttcacatccaactgtcagacagtatcgcggtgatactttaggctaccatgaggcgttacaagtgaaactaaaccccgctttccctgtaaggactcaagtaagagcatattatgtttccgaggatatctttgttgctagtgggcgcgcgactgccaacccccaatggggtaaaggtggaggaatgcagttttacatccctgaagaagctagagggaaactcataccaggaaaaatcattgacatatga

SEQ ID NO: 132 - DNA, 474 bp, unknown
  environmental sample
atgcaggaagatgcctaccggggagacgggctgaatctttatgcctattgccaaaacaacccagtcaactactatgaccctagcggatatatgtcaatatgtccagaaccgaaattcgctacaggaaatggcgatcaagaaactttataccattatacgaatgaaaagggaaagaatgctattcttgaatcacaagaattatttccatcattaaaagcaaataatcctaaagatgccagatatggagatgggcagtatttgtcagatattaatccgtctacaacaaaaccagcgtcacttgcaagtaagtttataagaactccaaataaatacaaatatactgattatgttgaaatagatgtatctggtctcaatgtagtaaaggggcgtgatggtgtatttgttattccaaacaatagctctttggatattagtggcagaattgttagttccggaaaagtcggaaaccagtag

SEQ ID NO: 133 - DNA, 2166 bp, unknown
  environmental sample
gtgaaaaggaagcttacgttcttagttgttttatttttatttacgaatgcatcttacctatctgcatgggctgaagaaacttccactttcgatacctctttcaccgagcagaccagtcagcttataagcagcgaagcggaagaagcaacctcgatgtcttcgacggagcaagaagctacatcttctgtccacagcccagaaacttcaattagcgaagaactcacagaggccagcagtgaaccggagcaggaagtccaagaagcaccagaaataagtatgatggcagccgctggagatggtactgaggctaatccatatcgaatcacaactttccaagaactgaaggatgccttggcaactacggtacccgctgggcaaacacaatatattcagctacaaaatgacattgtttacaatgctaattatatctatattaagcaaaatactgtgattgatgggaatggtaatgcgcttttatacagcggaacgaattatgatactgctcagcttagtgcaggagccagcaaccttacgatcacgtataaaaatttgtcatttggcaacagtacttatccgaataattcttggtatggcattttgtatgctggtggttataccggcaataaattgacggttgagaacattaattacaacattaaaaatggcagccagcctttttggggtggtaacaacgcgggcaacacattgacccttaaagggaagaataatttctactctgctggtacttctaatggcggagaatttgtcgagggatatgctagcgttgtttttgctgaaaacagcgatacgactatctataatgacgcaccgggcgcgacagctgttttctatagtagtaatcaaattgttacagtagaaaaaaatgcttcagtttctattgaatctagtaaagattatctattttataatagtgcgacattaaatgttcaggagcagggaagcttctcttataaaaccatttatggaactaactatcattcgaatatcgcaaacttgtgtgtagggacactgaccgctaattttgctgcggattcgattgggcattttacaacggatgtcaacagttttactggaaccaatccaatcttcaatctaagctcaccagattatgttgtctttgatgcaacaagctcgtctaaaaaagtgttagatacaatgaatccaatcttaaagcggatagattcagatacctctacttacaggattgattatctcactgccggcaaacaaaacacatatgtccctacagtaaacaccggttcaagctacaccatttcttcagggaatattaataacggttattcggtggcttatgctaaactccctacgattgacagcttatcggcaacgccggcgactggcccggacatcagtacaattgctgctcaaatagacaataccagtccggcaaatacattaagcagcaaggttcaatataaactagcaactaaccagctgtatagtggtgacttagcttcaaatacagctcaaaccagtatccagagcgctggaactgccgagggagttaaagagtccgcagatgtccctctgccaggaaattcaccaccagcaggagaagcttcaaaatacttgtttacgaacttatcagcaggcagctattatttatatgctcaggccaacgatcagcgtatccctggctatacctttgagagtctatggcaggaaacaaatgctgaggtatcgccttttgttctaatccagttttccagcggatcaatgagcttcaacagcccgatacccggtccattcggcaaacagcaaaatctagacaattacacgatacgcaacgctggaaatgtcccaacaaagattaacttaaccagcattacccgtaactcagacagctcagcaaagctttccttagtcgagcaatttgatactcggaatcaagagctgctcttatcgctaattgcagaaaaagcaggcagcggtactcggaccacctttggtcccttgctggacaagaatccgttaaatttagacaccctgcagcttgatcctttctgggaagcggatgctctggctgatctttacctagccggagattactcagggccgatgattggaccgcaaaatttcagctaccgtttttcttttgctatttcagcagctacaacaaattag

SEQ ID NO: 134 - DNA, 2172 bp, Enterococcus Sp.
gtgaaaaagaaggttgcatttttaattgttttatttttatttaccaatgcgtcttacttatctgcctgggccgcagaaacatctactgtcgcttcctcctccaccgaacagaccgatcagcttataaacagcgaaacggatactatacccccagtatcttcgacagaacaagagacgacctcttctgttcaccgttcggaaacttcgattagcgaagaaccaacgcagtcatcgtccgagatcagcagcgagccagaacaggaagttcaagaagcaccgaaaataagtgtgatggcagccgctggggatggtaccgaagcgaacccttaccgagtcacaacctttcaagaattgaaggatgccctagccacctcagtaacagctggacagacacagtatattcagctgcaaaacgatattgtttataacactaactatacgtacattaaacaaaatacggtcatagatggaaatggccatgcgtttttatacaacggaacagattatggtactgctcacttcagtactggagcaaacaatataagtgtcacatacaaaaatttgacttttggcaacagtacttatcccaacagttcttggtatggaattctttatacctcgaatagcaatgtttcattcaccgttgaaaatattaactacactatccaaagaggcagtcaacctttttggggaaacaataatgctgggaataccttaaccttcaaagggaaaaataatttttattcctctggtaattcttatggtggggaattcgttgaaggctatcgttctgttacttttgctgaaggtagtgacaccactgtctacaatgattcaactgatgctacagctgttttctacagtaccagccaatcagttaccgtagagaaacacgcttcactagccattgaatccagtaagacctatcttttttatggcagtgccactctaaatgttcaagaacaagggaatttctcctataaaaatatttacggagtcaactctacatcaagtacagcaactttatctacaggaacgctgactgctaattttgctaaggactcaattggacatttcacaacagatgttaatggattttctggacccaatccaacctttaatctgaactcaccagattatattgtctttgatgcaacaagctcatctaaaaaagtattaggttccatgaatccgatattcaagaggctggattcagataatgcttcttacagaatcgattatctaacggccagcaaacaaaacacatatgttcctacagtgaacactggttccagctatacgatttcatcaggaaatattggtgacggttattccgtggcctacgctaaacttcctacgattgacagcttatcagcgacaccaacaactggtccagatatcagtacgatgactgctcaaatagatagtacccgtccggcagacatgttaagcagcgaagttcaatataagctggcaactaagcagctttatagcggcacgctaacttcgaatacagctcaaactagtattcaaaacgctggagctgccgagggtgttaaagaaacagccgaggttactctgccaggagattcaccacctgccggagaagcttcgaagtattcatttacgaatttgccaccaagcagctactatttatatgctcaggccaacgatcagcgcatacccggctatacctttaaaagcttatggcaggaaaccaatgctgaggtaccacccgttgttctaatccagttttccagcggtacaatgagcttcgaaagtccgatacctggtcaatttggtaaacagcaaaatctagacaattatacgatccgcaacgctggcaatgtaccaacaaaggttgacttaaccagcattactcgcaattcagacagctcagccaagctttctttagttgagcaatttaacacgcatgagcaagagctgctcttatctctaatcgctgaaaaagcaggcagtggtgctcgaaccacctttggtcccttggtagacaaggacccgttaagtttagacaccctgcagcttgatcctttctgggaaacagatgctctggctaacttgtatctagccggagattactcgggaccactgattggaccacaacatttcagctaccgtttttcttttgctatttcagctgcgacaaattag

SEQ ID NO: 135 - DNA, 2181 bp, unknown
  environmental sample
atgaacaagggaataaaattagccgcagtaattttgctatcgcttcaggcatttgcacttcctgcttgggctgaagaagtttcaaccacagaagagtcttcatcacagcttcaacagccttcgagtgccagtagtgagctggaaagttcaagctcttcacaggaagataccgtgcaaactagcgacagcagcgaagaaagtgttgctactagtgaggagtcaggccctgaagcaacggaggcctccatcgagccagaacaggacattcaggaagctcttactcctaaaataggaacattagcagccgctggcgatggtactgaagcgaatccatatctagtgaccacttttcaagaattgacggatgcccttgctgcctcggtagccgcgggacagactcaatatatccagctgcaaaacgatattgtttataactctacttatacttatattaaacaaaatacagtgattgacggcaatggatatgctctgctgtataacggtacagcttatagtacggctcattttagcaccaatgctaataacatcagcattacttataaaaacctgaccttcggcaacagtgcttaccctaatagcacctactatgggattttgtataaccacaatagtaatgtcagttttacggttgaaaatgtgaattacaatattcaagttggcagccagcccttttggggaaacaataactctggtaatacactgaccttcaaaggaaaaaacaatttctactcctcgggtaggtcttatggtggggaattcatagagggatatcgcaacgttacctttgctgaaggcagtgacacaagtgtttataatgattcaaccgatgcaacagctattttctatagtactagtcaaacagttaccgtagaaaaaaatgcgtcgctttcgattgaaaccagcaaaccttatctcttttacaacagtgctactttgaatgttcaggagcagggaaagttttcctataaaaatatttatgggacaaactctacttcgagtgtcgcaaccttgtgtgttggaaccttgactgcaaattttgctgacgattctatcgggcattttacaacggatgttaatagttttactggcagcaatcccattttcaatctgaactcgccagattatgtagtttttgacgcgactagttcgtctagacaagtattaggtaccatgaacccgattttcaaacgggcggatacagattctgctttatacaagattgactatctgactgccagcggacaaaacacttatgtacctaaggtgaatactggctcaagctatactgttacctccgggaatattggcaatggctattcagttgcctacgctaaaatgccttcaatcgaaagtatgtcggcgataccagcgactggtccagatatcagtactattgacgcacaaatagacagtactagtcctgcaaacacgttaagcagcaacgttcaatataagttggcgataaaacagttgtacagtggggatctcgcttctgatgcggctcaaagcagcattcagaacgctggtacagccgatggcgtaaaggacagcgcagatgtaactctgccaggaacttcaccgccagtaggtacggacacgaaacattcgtttacgaaattacccgcgggaaattactatttgtatgctcaagcaaacgatcagcggattgctggctatacctttaacactctttggcaggaggcagctgccgatgtagcaccgttcgtcttgatacagttttccagcggaagcatgagcttcgacagtccgattccgggacaatttggcaagcagcagaatctggataactacacgatgcgcaatgccggcaatgttccgacagaggccagcttaacaagtattacccgtaacacggacagctcggacaaaatttctttagtggatcaatttagcactaataaacaagagctgatcttatctttaattgctgaaaaagctgacagtggggaacaaaccaagcttggtcctctcactgatgccaatcctctaaacttaagcaccgtccagctgaaccctttttgggacacagatgctcaggcagccttgtatctggccggtgattactcagggcctatgatcggtccgcaaaagtttagctaccgtttttcttttgctatttcagcagttactacgaattag

SEQ ID NO: 136 - DNA, 1218 bp, Morganella Sp.
atgactcagacttctgcctttcaccttgccgcagaaagtacccaaccacagttgcatatgctgacgttacaggcactgaatatgatcccgcccgcctctttcgccgtacccgccacttcaccgcagggaattgccaccaccattctcagcatggtgctgaaattggtttataaaaaaatgacagagccaaaggaagtggatgttattggtattattcaggaaacactgatgaaaaatacctctgaatggctggaatcggaatatcaggccgtccgcaaagatgccgaaagtctgcaggatgctatcagttcctggcaaaattcaccgacagaagaggcgcgccagctgattgtggtacgcaatgaaattgctgtcgcggatatgcgccggttatgtattctcagcatcaataccgcaaaaagcagaggtattgtccggctgtgcggtgtgtgtgccctgtcctgcctgctctatttctttacattacgcgataccctggtattcggcaagagctggggctatgcctccgatatgctggaaaagtacagcaaagccctgacggaacaggcggatattatgtttaaggacgtactgaccgcagaaatcaataattacaccgaaaatgatgatttttatgacccggaaagccaggccaaacgctccgttatttactggacatccggatacaccaacattcaggatcacctgacttacggcgcgcagcaaaaatccacacgggtctgccctgaacgcggcgatatagctgccaatccggttaatgctgacaaccacacggtttatctcggcaatctgtttctgaccgccgggaattcttctgcgaacggtagctataattatttatccgccaccgaaccccgcagctatgacagaggcggtgacccggtcacactgccggtcagaagtgccgggcagtataatatccggctgtattatgcctatatgaccaactccctcagttttgattatgaaactcagttgcggattgaacaggccggaaaaatcatcaccgatgcccatctgacagatttaaccaaaacggtgctgacaccgtataaatccgggtcaaattacggcccggtcatttaccgggagacccgggtgaaccttgaggaaggcgatattgtgctgacattacatgaggaccgttccctttccggcggcgggttgctgcagcatattgaatttgtgaaagtataa

SEQ ID NO: 137 - DNA, 1218 bp, Morganella Sp.
atgactcagacttctgcctttcaccttgccgcagaaagtacccagccacagttgcatatgctgacgttacaggcactgaatatgatcccgcccgcctctttcgccgtacctgccgcttcaccgcagggaattgccaccaccattctcagcatggtgctgaaactggtttataaaaaaatgacagagccaaaggaagtggatgttattggtattattcaggaaacactgatgaaaaatacctctgaatggctggaatcagaatatcaggccgtccgcaaagatgccgaaagcctgcaggatgctatcagctcctggcagaattcaccgacagaagaggcgcgccagctgattgtggtacgcaataagattgccatcgcaagtatgagccgcttatgcattctcagcatcaataccgcaaaaagaataggtattgtccggctgtgcggcgtgtgtgccctgtcctgcctgctctatttctttacactgcgcgataccctggtattcggcaagagttggggctatgcctctgatatgctggaaaaatacagcaaaactctgacggaacaggcggatattatgtttaaagacgtgctgactgcagaaatcaataattacaccgaaaatgatgatttttatgatccggaaagccaggccaaacgctccgttatttactggacatccgggtacaccaatattcaggatcatctgacttacggcgcgcaacaaaaatccaccagggtctgttctgaacgcagcgatatcgctgccaatccggttaatgctgaaaaccatatggtttatctcggcaatctgttcctgaccgccggaaattcttctgctaacggcagctacaattatttatccgccgccaaaccccgcagttatgacagagtcggagacccggtcacactgccggtcagaagcgccgggcagtaccatatccgcctgtactatgcctatatgaccaattcccttagtttcgattatgaaactcagttgcggattgaacaggccggaaaaattgttaccgatacccatctgacagatttaaccaaaacggtgctgacaccgtataaatccgggtcaaattacggcccggtcatttaccgggagacccgggtgaaccttgaggaaggcgatattgtgctgacattacatgaggaccgttccctttccggcggcgggttgctgcagcatattgaatttgtgaaagtataa

SEQ ID NO: 138 - DNA, 1131 bp, Morganella Sp.
ccgcccgcctcttttgtggttcctgccacatcaccgcagggaattgccaccaccattctcagcatggtgctgaaactggtctataaaaaaatgactgagccaaaagaagtggatgtcattggtattattcaggaaacactgatgaaaaatacctctgaatggctggaatcagaatatcaggccgtccgcaaagatgccgaaagtctgcaggatgctatcagttcctggcagaattcaccgacagaagaggcgcgccagctgattgtggtgcgcaatgaaattgctgtcgcggatatgcgccggttatgtattctcagcatcaatactgcgaaaagcagaggtattgtccggctgtgcggcgtgtgtgccctgtcctgcctgctctatttctttacattgcgcgataccctggtattcggcaaaagctggggatacgcctctgatgtactggaaaagtacagcaaagccctgacggaacaggcggatattatgtttaaggacgtgctgaccgcagaaatcaataattacaccgaaaatgatgatttttatgatccggaaagccaggccaaacgctccgttatttactggacatccgggtacaccaatattcaggatcatctgacttacggcgcgcagcaaaaatccacacgggtctgccctgaacgcagcgatatagccgctaacccggttaatgctgaaaatcatacggtttatctcggcaatctgtttctgaccaccggaaattcttccgttaacggcagctacaattatttatccgccaccggaccccgcagctatgacagaggcggagaaccggtcacactgccggtcacaagcgccgggcagtataatatccggctgtattatgcctatatgaccaactccctcagttttgattatgaaactcagcttcggattgaacaggccggaaaaatcatcaccgatgctcatctcaccgatttaaccaaaacggtgctgacaccatataaatccggctcaaattacggcccggtcatttaccgcgagacacaggtgaaccttgaggaaggcgatattgtgctgacattccatgaggaccgttccctttccggcggcggattgctgcagcatattgaatttgtgaaagtataa

SEQ ID NO: 139 - DNA, 1218 bp, Morganella Sp.
atgactcagacttctgcccttcacattgccgcagaaaacacccagccacagttacatatgctgacattacaggcactgaatatgatcccgcctgcatcttatgctgtaccggtcacttcaccgcagggaattgccaccaccattctcagcatggtgctgaaactggtctataaaaaaacgacagaaccaaaagaagttgatatcattgatattattcaggaaattatgttgaaaaataccgatgaatggcggagactggactatcaggcggtccgtaaaaatgctgaaaatttgcaggatgctatcagttcctggcaaaacgaaccgacagaagaggcgcgccagctgattgtggtacgcaatgagatcgctatcgcaagtatgaaccgcttatgcattctcagcatcgataccgcaaaaagaataggcattgtccggctgtgcggggtgtgtgccctgtcctgtctgctctacttctttacgctgcgcgataccctggtattcggcaggagctggggatatgcctccgatgtgctggaaaaatacagcaaaaccctgaccaaacaggctgatactatgtttaaagatgtgctgactgcggagctcaacaattacaccgaaaatgatgatttttatgacgcggaaagtcaggccaaacgttctgtgatttactggacatccgattataccaatattcaggatcacctgacttacggtgcgcagcagaaacccacccgtgtctgccttgaacgcggggatattgctgccaatccggttgatgctgaaaatcatacggtttatctcggcaatctgttcctgactgacggtaattcttccgctaacggcagttataattatttatccgtcaccgaaccccgcagctacaacagaggctgtgaccctgttacactgccggtcagaagtgccggtcagtatcatctccggctgtattatgcctatatgaccaattcactcagttttgattatgaaacccggctgaagattgaacagaccggaaaaaccgtcaccgatgcccatctgaccgatttaaccaaaacagtgctgacaccgtataaatccggctcaaattacggcccggtgatttaccgtgaaacacagctgaacctggaggaaggtgatattgtgctgacattctatgaggatcgctcattgtccggcggcgggctcttgcagcatgttgaactagtaaaagtataa

SEQ ID NO: 140 - DNA, 1557 bp, custom Sp.
atgaacatcaaaatcttcaaattcatcgacatctacaccaacggtatcttcgttgaattcaacaacaaagaaaacaaactgctgtctatcaacctgctgctgaacgacgaaatcatcgaaaaaaccgaaaccaccggtgaatctcacctgttctctatcgacaaatctggtcactaccgtgttgaaatctctctggaagcggaaaacaccgcgaacatccagtctaaagaaatctacttccacatctctgaaggtgaacgtaaaaacaaaatcaaaaccaccaccaaagaaaaaaccatcaaccagaaaatcgcgggtatctctaactactacctggacatcaaagcgaaaaaaaaaaactacgacaaaatcaaacaggacctgaccttctactctaaactgccgaccctggaactgaaacgttctctgatctacgacaccctgaacgaatacgactacttcaccttccacggtgacggtaaattcgaaatcctggttgaactggcggaacagatcgaatctctggactacgttgaatactgctctgttaccccggacaccaccggttacctggcgccggaactgccggttaacccggaacagctggacgacatcaaatctgaatctgacgacttcatcaccccggacttcaccccgcgtcagacctacctggacgcgccgaaaggtatgaacatccgtgacgcgtgggcgaaaaacatcaacggttcttctgcggttgttcgtcacctggacttcggtgtttaccgtaaccacgaagacctgatcgactctaacatcgttgttgttaactctcgtccggaatctgaagactgcaaccacggtaccgcgtctaccggttgcatcgttgcgaccctgaacaaattcggtgttaccggtatcgcgcaccactgccagttctacttctacgacaccggtgacctggacctgatcgttaaccacgttcagccgggtgacatcgtttctctggacatccagttcggtgttggtggtaaactgctgccggcgaccgcgatccgttcttggtgggaacgtatgaaaatcatcgttgacaaaggtgcgaccgttatcctggcggcgggtaacggtggtctggacctgtctgaaccgggtgttatgcaggacttcggtgactctggttctatcctggttggtgcgtgcaaccaccagaacggtacccgtgcgtacttctctaactacaacccggaagttgcgttcgttaactcttggggtgactggtctgttaccaccaccggttacggttctctgcagaaactgccgggtaacaaccgtaactactctaacaactactctggtacctcttctgcgaccccgctgtgctctggtgcgctggcgctgatccaggactacgcgaaaaaacagggtgcgatcctgtctccgtggcagatgcgtaccgttatcgcggcgtctaactacaccgaaggtgtttctcacggtatcggttgccgtccgaacgttgactacctgttcggtatcgttgactctatcatccgtaaatctgacctgccggaatctgcg

SEQ ID NO: 141 - DNA, 1557 bp, custom Sp.
atgaacatcaaaatcttcaaattcatcgacatctacaccaacggtatcttcgttgaattcaacaacaaagaaaacaaactgctgtctatcaacctgctgctgaacgacgaaatcatcgaaaaaaccgaaaccaccggtgaatctcacctgttctctatcgacaaatctggtcactaccgtgttgaaatctctctggaagcggaaaacaccgcgaacatccagtctaaagaaatctacttccacatctctgaaggtgaacgtaaaaacaaaatcaaaaccaccaccaaagaaaaaaccatcaaccagaaaatcgcgggtatctctaactactacctggacatcaaagcgaaaaaaaaaaactacgacaaaatcaaacaggacctgaccttctactctaaactgccgaccctggaactgaaacgttctctgatctacgacaccctgaacgaatacgactacttcaccttccacggtgacggtaaattcgaaatcctggttgaactggcggaacagatcgaatctctggactacgttgaatactgctctgttaccccggacaccaccggttacctggcgccggaactgccggttaacccggaacagctggacgacatcaaatctgaatctgacgacttcatcaccccggacttcaccccgcgtcagacctacctggacgcgccgaaaggtatgaacatccgtgacgcgtgggcgaaaaacatcaacggttcttctgcggttgttcgtcacctggacttcggtgtttaccgtaaccacgaagacctgatcgactctaacatcgttgttgttaactctcgtccggaatctgaagactgcaaccacggtaccgcgtctaccggttgcatcgttgcgaccctgaacaaattcggtgttaccggtatcgcgcaccactgcaccaccgttggttacaaccgtgttgacctggacctgatcgttaaccacgttcagccgggtgacatcgtttctctggacatccagttctctgttggtggtaaactgctgccggcgaccgcgatccgttcttggtgggaacgtatgaaaatcatcgttgacaaaggtgcgaccgttatcctggcggcgggtaacggtggtctggacctgtctgaaccgggtgttatgcaggacttcggtgactctggttctatcctggttggtgcgtgcaaccaccagaacggtacccgtgcgtacttctctaactacaacccggaagttgcgttcgttaactcttggggtgactggtctgttaccaccaccggttacggttctctgcagaaactgccgggtaacaaccgtaactactctaacaactactctggtacctcttctgcgaccccgctgtgctctggtgcgctggcgctgatccaggactacgcgaaaaaacagggtgcgatcctgtctccgtggcagatgcgtaccgttatcgcggcgtctaactacaccgaaggtgtttctcacggtatcggttgccgtccgaacgttgactacctgttcggtatcgttgactctatcatccgtaaatctgacctgccggaatctgcg

SEQ ID NO: 142 - DNA, 1560 bp, custom Sp.
atgaacatcaaaatcttcaaattcatcgacatctacaccaacggtatcttcgttgaattcaacaacaaagaaaacaaactgctgtctatcaacctgctgctgaacgacgaaatcatcgaaaaaaccgaaaccaccggtgaatctcacctgttctctatcgacaaatctggtcactaccgtgttgaaatctctctggaagcggaaaacaccgcgaacatccagtctaaagaaatctacttccacatctctgaaggtgaacgtaaaaacaaaatcaaaaccaccaccaaagaaaaaaccatcaaccagaaaatcgcgggtatctctaactactacctggacatcaaagcgaaaaaaaaaaactacgacaaaatcaaacaggacctgaccttctactctaaactgccgaccctggaactgaaacgttctctgatctacgacaccctgaacgaatacgactacttcaccttccacggtgacggtaaattcgaaatcctggttgaactggcggaacagatcgaatctctggactacgttgaatactgctctgttaccccggacaccaccggttacctggcgccggaactgccggttaacccggaacagctggacgacatcaaatctgaatctgacgacttcatcaccccggacttcaccccgcgtcagacctacctggacgcgccgaaaggtatgaacatccgtgacgcgtgggcgaaaaacatcaacggttcttctgcggttgttcgtcacctggacttcggtgtttaccgtaaccacgaagacctgatcgactctaacatcgttgttgttaactctcgtccggaatctgaagactgcaaccacggtaccgcgtctaccggttgcatcgttgcgaccctgaacaaattcggtgttaccggtatcgcgcaccactgcaccaccgttggttacaaccgtgttgacctggacctgatcgttaaccacgttcagccgggtgacatcgtttctctggacatccagaccggtggtaaagacggtaaactgctgccggcgaccgcgatccgttcttggtgggaacgtatgaaaatcatcgttgacaaaggtgcgaccgttatcctggcggcgggtaacggtggtctggacctgtctgaaccgggtgttatgcaggacttcggtgactctggttctatcctggttggtgcgtgcaaccaccagaacggtacccgtgcgtacttctctaactacaacccggaagttgcgttcgttaactcttggggtgactggtctgttaccaccaccggttacggttctctgcagaaactgccgggtaacaaccgtaactactctaacaactactctggtacctcttctgcgaccccgctgtgctctggtgcgctggcgctgatccaggactacgcgaaaaaacagggtgcgatcctgtctccgtggcagatgcgtaccgttatcgcggcgtctaactacaccgaaggtgtttctcacggtatcggttgccgtccgaacgttgactacctgttcggtatcgttgactctatcatccgtaaatctgacctgccggaatctgcg

SEQ ID NO: 143 - DNA, 1557 bp, custom Sp.
atgaacatcaaaatcttcaaattcatcgacctgtactctaacggtatcttcgttaacttcaacaacaaagaaaacaccaacatcgaaatcaacctgctgctgaacgacaacatcatcgaatctatctctaccaaaaacgaacaccacctgttcaacatcgacaaatctggtaactaccacgttgaaatctctctggaagcggaaaacaccttcaacacctcttctaaaaacatccaccacctgatctctgaaccggttcgtaaaaaaaaaatcaaaaaaaccgttaaatctaaaaccatcaaccacaaaatcgacggtatctctaactactacctggacatcaaagcgaaaaaaaaaaactacaacaaaatcaaacaggacctgaccaacgtttctcagctgtctaccctggaactgaaaaaatctaacatccagtcttctctgaaccagtacgactacttcaccttccacggtgaaaccaacttcgaagacctgctggaactggcggaacagatcgaaaaactggactacgttgaatactgctctgttaccccggacaccaccggttacctgccgccgcagctgccgctgaacccgcagcagctggaaaacatcaaatctgttgacgacaccgacatcaccccggacttcacccacctgcagacctacctggacgcgccgaaaggtatgaacatccgtaacgcgtgggcgaaaaacatcaacggttctcaggcggttgttcgtcacctggacttcggtgtttacaaaaaccacgaagacctgaaagactctaacatcaccgttgttaactctcgtccggaaaccgaagactgcaaccacggtaccgcgtctaccggttgcatcgttgcgaccaaaaacgcgttcggtgttaccggtatcgcgcacgactgccagttctacttctacgacaccggtgacctggacctgatcgttaaccacgttcagccgggtgacatcgtttctctggacatccagttctctgttggtggtaaactgctgccggcgaccgcgatccgttcttggtgggaacgtatcaaaatcatggttgacaaaggtgcgaccgttatcctggcggcgggtaacggtggtctggacctgtctgaaccgggtgttatggcggacttcggtgactctggttctatgctggttggtgcgtgcaaccaccagaccggtacccgtgcgtacttctctaactacaaccagaaaacctctctggttaactcttggggtgactggtctgttaccaccaccggttacggttctctgcagaaactgccgggtaacaaccgtaactacaccaacaactactctggtacctcttctgcgaccccgctgtgctctggtgcgctggcgctgatccaggactacgcgaaacagcagggtatcatcctgtctgcgtggcagatgcgtgaactgatcaaaaaatctacctacaccgaaggtgttggtgacggtatcggttaccgtccgaacgttgacgacctgttcaaagaaatcgacaaactggcgcagatcaccgaagcgaacaacgaaggt

SEQ ID NO: 144 - DNA, 1551 bp, custom Sp.
atgaacatcaaaatcttcaaattcatcgacttcgactctaacggtatcttcgttgaattcaacaacaaagaaaaaaaaaacgttgaaatcaacctgttcctgaacaacgaaatcatcgaatctatcgaaaccaaagaagaccaccacctgttcaacgttgacaaatctggtgactaccacgttgaaatctctctggaaaacgaaaacaccctgaacctgaactctaaagaaatctctttccacatcccgcagaaacagaccaaaaaaaaaatcaaaaaagcggttaaatctaaaaccatcaaccagaaaatcgacggtatcaacaactactacctggaaatcaaagttaaaaaaggttcttacgacaaactgaaacaggaactgaccttcaactctaaactgccgatcgacgaaatcaaacgtaacatcgttcgtcactctctgaaccagtacgactacttcaccttccacggtgacaccaacttcgaagacctgctggaactggcggaacagatcgaaaaactggactacgttgaatactgctctgttaccccggacaccaccctgccgccgaaactgccgctgaaccaggaaaccctggacgaagttaaatctgttgacgacgacttcatcaccccggacttcacccacctgcagacctacctggacgcgccgaaaggtatgaacatccgtaacgcgtgggcgaaaaacatcaacggttctcaggcggttgttcgtcacctggacttcggtgtttacaaaaaccacgaagacctgaaagactctaacatcaccgttgttaactctcgtccggaaaccgaagactgcaaccacggtaccgcgtctaccggttgcatcgttgcgaccaaaaacgcgttcggtgttaccggtatcgcgcacgactgccagttctacttctacgacaccggtgacctggaccagatcgttaaccacgttcagccgggtgacatcgtttctctggacatccagttctctgttggtggtaaactgctgccggcgaccgcgatccgttcttggtgggaacgtatcaaaatcatggttgacaaaggtgcgaccgttatcctggcggcgggtaacggtggtctggacctgtctgaaccgggtgttatgccggactacggtgactctggttctatgctggttggtgcgtgcaaccaccagaacggtacccgtgcgtacttctctaactacaaccagaaaacctctctggttaactcttggggtgactggtctgttaccaccaccggttacggttctctgcagaaactgccgggtaacaaccgtaactacaccaacaactactctggtacctcttctgcgaccccgctgtgctctggtgcgctggcgctgatccaggactacgcgaaacagcacggtatcatcctgtctgcgtggcagatgcgtgaactgatcaaaaaatctaactacaccgaaggtgttgacgacggtatcggttaccgtccgaacgttgacgacctgttcaaagaaatcgacaaactggttcagatctctgaaccgaacgaaaacgcg

SEQ ID NO: 145 - DNA, 1578 bp, custom Sp.
atgaatattaaaatttttaaatttattgatatttattcaaatggtatttttgttaattttaataataaagaaaataaaaccgttaccattaatttgtttttgaataatgaaattattgaatcaattgaaaccaccgatgattcacatttgtttaatattgataaatcaggtgattatcatgttgaaatttcattggaaaccttgtcagaaaatattgctaatttgaattcaaaagctatttcatttaatatttcacaaaccaaaaccaaaaaaaatattaaaacctcaaccaaatcaaaaaccattaatcaaaaaattgatggtattaataattattatttggatattaaagctaaaaaaggtaattatgataaaattaaacaatcaaaattgttgattgatattttgccaattaatattgctaattcaaaattgattttgattaaatcattgatttcacaatcaattaatcaatatgattatttgaatttttatggtgaagctaattttgaatcattgttggaattggctcaacaaattgaaaccttggattatgttgaatattgctgcgttaccccagataccaccggttatttgccaccaaaattgccattgaattcagaaaatttggaagatgttacctcatcaaatgatattaccccagattttacccatttgcaaacctatttggatgctccaaaaggtatgaatattcgtaatgcttgggctaaaaatattaatggttcatcagctgttgttcgtcatttggattttggtgtttataaaaatcatgaagatttgaaagattcaaatattaccgttgttaattcacgtccagaaaccgaagattgcaatcatggtaccgcttcaaccggttgcattgttgctaccaataatgcttttggtgttaccggtattgctcatgattgccaattttatttttatgataccggtgatttggatcaaattgttaatcatgttcaaccaggtgatattgtttcattggatattcaattttcagttggtggtaaattgttgccagctaccgctattcgttcatggtgggaacgtattaaaattatggttgataaaggtgctaccgttattttggctgctggtaatggtggtttggatttgtcagaaccaggtgttatggctgattttggtgattcaggttcaatgttggttggtgcttgcaatcatcaaaatggtacccgtgcttatttttcaaattataatcaaaaaacctcattgattaattcatggggtgattggtcagttaccaccaccggttatggttcattgcaaaaattgccaggtaataatcgtaattattcaaataattattcaggtacctcatcagctaccccattgtgctcaggtgctttggctttgattcaagattatgctaaacaacatggtattattttgtcagcttggcaaatgcgtgaattgattaaaaaatcaacctataccgaaggtgttaatgatggtattggttatcgtccaaatgttgatgatttgtttaaagaaattgataaattgattcaaattaccgaagctccagaatcagcttaa

SEQ ID NO: 146 - DNA, 1641 bp, custom Sp.
atgaacatcaaaatcttcaaattcatcgacttcgactctaacggtatcttcgttgaattcaacaacaaagaaaaaaaaaacgttgaaatcaacctgttcctgaacaacgaaatcatcgaatctatcgaaaccaaagaagaccaccacctgttcaacgttgacaaatctggtgactaccacgttgaaatctctctggaaaacgaaaacaccctgaacctgaactctaaagaaatctctttccacatcccgcagaaacagaccaaaaaaaaaatcaaaaaagcggttaaatctaaaaccatcaaccagaaaatcgacggtatcaacaactactacctggaaatcaaagttaaaaaaggttcttacgacaaactgaaacaggaactgaccttcaactctaaactgccgatcgacgaaatcaaacgtaacatcgttcgtcactctctgaaccagtaccgtgactacttcaccttccacggtggtgacaccaacttcgaagacctgctggaactggcggaacagatcgaaaaactggactacgttgaatactgctctgttaccccggacaccaccggttacctgccgccggcggaaaaactgccgctgaaccaggaaaccctggacgaagttaaatctgttgacgacgacttcatcaccccggacttcacccacctgcagacctacctggacgcgccgaaaggtatgaacatccgtaacgcgtgggcgaaaaacatcaacggttctcaggcggttgttcgtcacctggacttcggtgtttacaaaaaccacgaagacctgaaagactctaacatcaccgttgttaactctcgtcgtaccccgaacccgtctctgccggaaaccgaagactgcaaccacggtaccgcgtctaccggttgcatcgttgcgaccaaaaacgcgttcggtgttaccggtatcgcgcacgactgccagttctacttcgttttcccggaatggacccagggtggttacgacaccggtgacgcgctggaccagatcgttaaccacgttcagccgggtgacatcgtttctctggacatccagttctctgttctgggtggtaaactgctgccggcgaccgcgatccgttcttggtgggaacgtatcaaaatcatggttgacaaaggtgcgaccgttatcctggcggcgggtaacggtggtctggacctgtctgaaccgggtgttatgccggactaccgtgcgcgtggtgactctggttctatgctggttggtgcgtgcaaccaccagaccaacggtacccgtgcgtacttctctaactacaaccagaaaacctctctgaactcttggggtgactctgttaccaccaccggttacggttctctgcagaaaccgctgccgggtaacaaccgtaactacaccaactactctggtacctcttctgcgaccccgctgtgctctggtgcgctggcgctgatccaggactacgcgaaacagcactacggtatcatcctgtctgcgtggcagatgcgtgaactgatcaaaaaatctaactacaccgaaggtgttgacgacggtggtcagggtatcggttaccgtccgaacgttgacgacctgttcaaagaaatcgacaaactggttcagatctctgaaccgaacgaaaacgcg

SEQ ID NO: 147 - DNA, 1566 bp, custom Sp.
atgaacatcaaaatcttcaaattcatcgacttcgactctaacggtatcgttgttaacttcaacaacggtaacaaaaaaaccgttaccatcggtctgttcctggacaacgaaaacatcgaaaaaatcgaaaccaaagaagaacaccacctgttcaaagttgacaaatctggtaactaccacgttgaaatctctctggaagacctgaacgaaaacaccctgcacctgatctctaaaccgatctctttctacatcccgcagcagaaaaccaaaaaaaaaatcaaaaaagaagttaaatctaaaaccatcaaccagaaaatcgacggtatcaacaactactacctggaaatcaaatctaaaaaaggttcttacgacaaactgaaaaacgaactgaccttcaactctaaactgccgatcgacctgatcaaactgaacatcgcgccggttaactctaccaaccgttcttctctgacccagtacgactacttcaccctgtacggtgaagacaacttcgaagacctgctggaactggcgcagaaaatcgaaaaactggactacgttgaatactgctctgttaccccggacaccaccggttacctgccgccgaaactgccgctgaactctgaaaccctggaagaaaaagactctgaagacgacatcaccccggacttcaccgaactgcagacctacctggacgcgccgaaaggtatgaacgttcgtaacgcgtgggcgaaaaacatcaacggttctctggcggttgttcgtcacctggacttcggtgtttacaaaaaccacgaagacctgaaagactctaacatcaccgttgttaactctcgtccggaaaccgaagactgcaaccacggtaccgcgtctaccggttgcatcgttgcgaccaaaaacgcgttcggtgttaccggtatcgcgcacgactgccagttctacttctacgacaccggtgacctggaccagatcaccgacgacgttcagccgggtgacatcgtttctctggacatccagttccgtatcaacggtaaactgctgccggcgaccgcgatccgttcttggtgggaacgtatcaaaatcatggttgacaaaggtgcgaccgttatcctggcggcgggtaacggtggtctggacctgtctgaaccgggtgttatggacgactacggtgactctggttctatgctggttggtgcgtgcaaccaccagaccggtacccgtgcgtacttctctaactacaaccagaaatcttctctgatcaactcttggggtgactggtctgttaccaccaccggttacggttctctgcagaaactgccgggtaacaaccgtaactacaccaaacgttactctggtacctcttctgcgaccccgctgtgctctggtgcgctggcgctgatccaggactacgcgaaacagcagggtatcatcctgtctgcgtggggtatgcgtgaactgatcgcgaaatctacctacaccgaaggtgttaacgacggtatcggttaccgtccgaacgttgacgacctgttcgcggaaatcgacaaactggcgcagatctctgaagcgaac

SEQ ID NO: 148 - DNA, 2169 bp, Providencia Sp.
atgaatcccccttcgtcaaaattgaaacctaaactaccgaacagtttgctcctctctacggcaatttggtctacggctattttgccaatggtgccaagttatgcccaaatcgtccatttagacgatttacctacactcggtggtcaggccattcaatttgaaggaacccaacctgaagatagtactgaacgttttttagcggaatatggacaaaatgccgcaaactttgcttctgaagaaaaaaacaccaaaaatctggcagatatggcacaagattacgctcgccataaagccgcaaatatggcgacggatgaaataacacattggttatccaaagccggtaatgccaggctaaatattaatctcgataaaaaattgtcaattaagacatctcaattagattggttagtaccttggtatgaacaacaagatttgttgttattttctcagcacagtattcaccgcactgatggccggctacagaccaataacggtattggtttacgtcatttccaacaaaatagcatgataggggtaaatgctttctttgatcatgatttatcccattaccattcgcgcttagggtttggtgtggaatatgctcaagattacgttcgaatgagtgcgaatagctatttgggactatcgacttggcgcagtgcatccgaattagccgatgattataacgcacgccccgccaacggctgggatattcaacttgaaggttggctacccacgtatgcgaatttaggtgcaaacctaaaactggaacaatattacggagatgacgtcgctttatttggcaaaaatgagcgccagaaagacccaatggcggctaccgtcggcgtcaattggtctccatttcccctgctcgcaataaatgcagaacataaaataggcaatagtggaacaaatgagacaaatgcaaaagtggcgtttaattggttgctaggaaggagcttagcgcaacatcttgatacttcggcggtagcggccactcgccatatttccaccaatcgctatgattttattaaccgtaataacaatattgtgttggaataccaaaagaaaagcttaatttcattatcattaccgaaagttattcagggtatgacaggagaagaactttctattatccgcaatttaaccacgaaatacccgctagaaaaaatagtgatagaagcccctgaattgatagccgctgggggggaaatacaccttaatggcagagaaagttcagtaaaactaccgtcttataaaattgccaatcattcatttaaaaactcacaactcaatctttatcgcttaaccgtgacggcttatgacattaacggaaatgtttccccacaagcagaaacgttaattgaagttaccaacacaggcgctctcactatcacccataagaataccgcaaaaagaaataatgctgtcgctgatggtaaaaatacaaatatattcactgtagtaattaaagatactcttggccacccagtacccaatgcgaaagtcaatttcacattgcctgcaaatcttaattctattaatcaaaaaaatacgggatattattcattacttaatcattttatgtgggaggctcaggcagaaaaatcagtttctgaacaatcccatagcatcatcgctaacagtaaaggtgaagcttccattcaatttactagtttggtatcaggaagttatgcaataaaagcaaatattgagcatggtacagaaattaatgaaatatataactttaaatccgatattagccagtcatttattggtagcgtcgatatcattcaaaacaatgcagtggcagatgggatcagtaaaaacaaaattaaactgcatattgtgaataatagccgacaaagcatcgcaggagcacacgttcactttgaagcagcaaatgccattatctcaccaattaaattgactgatgaatatggaaatacagaattagaaatcagcagcttagtcgaaggttctataaatatcattgccaccctgaatggcgatagtcgaacaatacaagttaactttctaagggatggatctgcgataaatattcagccaagtattgggactctttttaaatctacagtaaatgaacaaaacagccatccacgcacaccgttaagtttgctaagggagctatttcaaaatatgggataa

SEQ ID NO: 149 - DNA, 2169 bp, Providencia Sp.
atgaatgccccttcgtcaaaattgaaacccaagctaccgaaccgtttggtactctctacggctatgtgctcaatagctattgtgcctgtcgcaccaagttatgcccaaatccctcatttggacgatttgccgacactcggtagtcatgccattcaatttgaagaaagccaaccagaagatactactgaacgttttttagcagaatatgggcaaaatgccgcaaattttgctgctacagaaaaaaacagcaaaaatttggcagaaatggcgcaagactatgcacgccataaagccgcaaatatcgcgactgatgaaataacacattggttatcgaaagcaggtaatgctagattcaatcttaaccttgataaaaaattatcaattaaaaatacccaattagattggttaataccttggtatgaccaaccagatttattgctattttctcagcacagcattcatcgcactgatggtcggttacaaaccaatacaggtattggattacgtcatttccagcaaaatagcatggtcggggtgaatgctttttttgatcatgatttatcccattaccattcacgattagggtttggtgtagaatatgcacaagattacgccagaatgagtgtgaacagctatttggggctatcgacttggcgaagtgcatccgaattagcttatgattataacgcgcgccctgctaacggctgggatattcaatttgaaggctggttgcccacttattctaatttaggggcgagcctaaaattggagcaatattatggcgatgacgtggctttatttggtaaaaatgagcgccagaaagaccctatggcggcgactgtcggcatcaattggtctccattccccctcctcgcgctaaatgcagaacataaaatgggcagtagtggcgcaaatgaaacaagtgcaaaaattgcattcaattggttgttagggaaaagcttagcgcaacatcttgatgcttcagcgatagaagctacccgccatattcctagcaaccgctatgatttcgttaatcgtaataacaatattgtgttggagtaccaaaagaaaaccttaatttcattatcattaccgaaagttattcaaggaataacaggagaagagctctctattatccgcaacttaaccactaaataccctttagacaaagttgttatagaagcgcctgaattggttgcagcaggaggagaaatccaccttaatggcatagaaagttcagtcaaactaccgtcatataaaattgccaacgacaccattaaaaatcaacaactcaacctttaccgtttaaccgtgacggcttatgacaccaacggaaatgtttccccgcaagcggaaacgttaattgaagtgactaacacaggcactctcactatcagccatgcaaataccgccaaaagaaacaatgccgttgctgatggtaaagatgcaaatacattcgccgtagtaattaaagatgctcttggccaccctgtacccaatgcgaaagtaaactttatattacctgcaggtcttaaatctattgatcaaaaaaatacaggatacgattccctactaaatcactttatgtggaaagcccaagcgacgaaatccgtttctgaacagccgtatagcatcgttaccaatagtaaaggtgaagcttctattcagttcacctcttttatatcaggaagttatgcaataaaagcaaagactgagcatggtacagaaataaatgagatgtatagctttaaacccgatattaaccaatcatttattggtagcattgatatcattcaaaacaatgtaatggcagacgggatcagtaaaaacaaaattaaactgcatattgtgaataacagccgacaaagcattgctggcgcgcttgttcattttgaagcgccaaatggcattatctcaccagctaagctgactgatgaacatggcaatacggaattagaagttagtagcttagttgaaggttctatagatatcattgcaaccctaaatggcgatagtagaacaatacaagttaactttcaaaggaatggatctgcgataaatattcagccaagcacaggaactcttttcaaatccccagtaaatgagcaaaacagtcctacacgcacgccgttaagtttgctaaggcagttatttcaaaaaataggataa

SEQ ID NO: 150 - DNA, 2214 bp, Pseudomonas Sp.
atgaactccgtaaacaccctcgcaaaccgctatcagccgccctcattcgccgaacggcccagctatgccggggccgcttcaggcaagccgtcctacaccaccgagcaagcggcagagcagatcacccgaacaggctatcgttggacagagcgtaaccaagatggcaccacacccatcggctatcgttttttcacaccttcgcaggccacgtacagcacacccgccggcgctaacgaattctccccgtcgcaaaaagagcaggccaggcgcgccatgcagtcttgggcggatgtcgccaatatcaccttcactgagaatgcacccgaggccaaagggcaactgttactgggcaatgacccgaaccagaccggccattcgggccgtgcgtcttatccaggcatctacagcgatggcacacaggcctggttcgcgtccgatggcatgaatcgccccttcacccagggcagtttcagccgttatctgctggcccatgagatcggccataccctggggctgatgcaccccggcaaatacaacaatggcggcagctacgctgaaagcgccggctatgccgaggacaatcgcgcctacagcctgatgagttactggtgggctggtcacctgggccatgaccacaacaagaacggccaaacccactatgccagcgcgccgctgatggacgacatcaccgccatccaaaagctctacggcgctaattacaaaacccgcgacaccgacacggtgtacggcttcaactccaataccgggcgtgacttcctcagcctcaactcagcggacgacgcacccgtgttcagcgtgtgggatgggggcggcaacgacaccctggatttctcgcggtttcatcaggaccagaccatcaacctgaaggctgaacacttctccgatgtcggcggcatgaaaggcaacgtctccattgccaaaggcgtgactctggaaaatgccattggcggcacgggcgctgatcgacttatcggcaaccaggccgataaccgcctgaccggtggcctgggccaggacacccttaccggtgggctgggcaaggatacctttgtgtataacagcgccagcgagtcgacccaacagcgccccgacctgatcactgatttcaccagtgggcaggacaagatcgatgtgtccgctgcgctgcataccgccgggatcaaggacctgcagtttgtacgtcgtttcagcggtcggccgggcgaggcgttgctcggttatgacccgaacacgcgccagcacagcctggccattgacctgaacggctcgggccaagccggcctgtttatcaagagccaagggccaatcaagccagacgacgtgatcagccgagcctcccagccgaaccctatgccgaccccacccgcccgggttacgcctcaaccgccaaccccgcgaccgccgtcgccagcggatgtcgcaccgtacaagccccatcccacgccaacagccgcgccgcaacaggcgccgttctccttgcagaaccacgccaacgcatcccttaagggcacaccgatgcatgcagcggccagggccgtgggcaatattcgcgaggtgacagtcacacgggactcatggggctacgaacgcgtgcatacccgctcgttgggtaccggctcgctgatcaacgatggcaacagcgtgctgaccaaccaacatgtgcgcgacgcgctggccaagggcagcaagctcgagctttggctgggttatgaacaagacagtagcgggcggatgaaggtagagcgcaaagtgccgctggaccccaacccgctcagtggcgacgcgcggctggactacgccgagctgcgtgtcgatttgcccgccggcgagaaaaaagccttggccgagcagttccggccgctcaagttggcctccggcccccaagcatcgcctgggcagaaagtctttatgcccaaccatggacaagaggccctcggcatttcatttctaaatgccaagggccaacccgccacgctcaacggatacgaccaggacagccgttttcagggcacggtctaccacgacgccttcaagaaacccggcacctccgggtcaccgctgatcagcgtcgatacgggcgagatcgtggccttgcacaacggctccatcggcgccagcgtgaacgggcagcgcgactctatgggcacggccacccgcatcgacttgatccaacagcaccgtcgtcagaggtga

SEQ ID NO: 151 - DNA, 2214 bp, Pseudomonas Sp.
atgacctccgtaaacaacaacctcacacaccgctatgacccgccttcattcgcccaacggcccagctatgccgaggccttttcagacaagccctcctacaccaccgagaaagcggcagagcaaatcacccgaacgggctatcgttggaaagagcgtaaccaagacggcaccacccctatctcctatcgctttttcaaaccctcgcaagccacctacaacacacccgccggcgctaacgagttctccccgtctcaaaaagagcaggccaggcgcaccatgcaggcttgggcagatgttgccaatatcgccttcactgaaaatgcaccccatgccaaagggcaacttttactgggtaatgacccgcacaccggcctggcgggatatgcgtcttatccaggcatctacagcgacggcacacaagcctggctcgcgtcagatggtacgaatcgccccttcactcacggtagtctcggccggtatgtgctggcccatgagatcggccacacccttgggcttatgcatcccggcaaatacaacaatggcggcagttacgctgataacgccagctacgccgaggacaatcgtgcctacagcctgatgagttactggtgggcaggccatctcggtcatgatcacaacaagaacggccaaacccactatgccagcgcgccgctgatggacgacatcaccgccatccaaaagctctacggtgccaatttcaaaacccgcgacaccgacacggtctacggcttcaactccactaccgggcgtgacttcctcagcctcaactcacccgacgacgcgccggtattcagcgtgtgggatggaggcggcaacgacacgctggatttttcggggttttatcaggaccagaccatcaacctgaaggctgaacatttctccgatgtcggcggcatgaaaggcaacgtctccattgccaaaggcgtgacgctggaaaatgccatcggcggcacgggcgctgatcgactcatcggcaaccacgccgataatcgcctgaccggtggcctgggccgggacatgcttaccggtgggctcggcaaggatacgttcgtctataacaacgccagcgagtccaccgaacaacgcccggacctgattaccgatttcaccagcgggcaggacaagatcgatgtgtccgccgcgctgcaggccgccagtatcaaggacctgcactttgtccgccgtttcagcggccggccgggcgaggcgttgctcggctatgacccgcgcacacgccaacacagcctggccattgacctgaaaggttccggccaagccgacctgtacatcgtaagccaagggctaatcaagcctggagacgtgatcagccaagcgtccctacccgacagtgcgccaaccccgcccattcagctcacgcctcaaccgctaggcccgcaaccgccctcgctaccgattaaggcactgcacaagcgacacaccacgccagtcaccgcgccacaacaggcgcccttctccttgcagaatcacgccagcgcctccctcaaaggcacgccgatgcatgcagcggccagggccgtgggcagtattcgcgaagtgagcgtcacacgtgactcatggggctacgaacgcgtgcattcccgcgcattgggtaccggctcgctgatcaacgatggcaacagcgtgttgaccaaccaacatgtgcgcgacgcgctggccaggggcagcaagctcgagctttggctgggttatgaacaagacagcagcggccggatgaaggtagggcgcaaagtgccgttggaccccaagccgctcagtggggatgcccggctggactatgccgagctgcgtgtcgacttgcctgcccaagagcgaaagaccttggccgagcagttcccgcccctcacgttggccgcccacccacaggcatcgcctgggcagaaagtctttatgcccaaccatgggcaagaagccctcggcatttcatttctaaatactaagggccaacccaccacactcaagggatacgaccaggacagcccttatcagggcacggtctaccacgatgccttcaagaaacccggcacttccggctcaccgctgatcagcgtcgacacgggagaaatcgttgccttgcacaacggctccatcggcaccaacgtcaacgggcaccgtgactccatgggcacggccacccgcatcgacttgattcaacagcaccgtcgtcagaggtga

SEQ ID NO: 152 - DNA, 1617 bp, Stenotrophomonas Sp.
atgcagggtgctgtacatggcaggcgatgcaccggggatgcgcggggtcgaccctggctgaccaacagtgggcacgccgccaccatcgtgattcttgcgggcaaggacctggtccccgtcgcgaagaactcctctggtgttggcgcatccacgcagaagtcaaagaggtccacgcccatgtcgtcagaattccgtaattcccatctccgtaacccggtcgctccgatcgaggatcccggcaggcgccgcctgatgcagtccgcgctggccggttcagcctgcctggtagcggcaccgttgctggcccaccaaggcttggtggattcatggggtgaacccattggcagggaagccaaagccagcgctggtgacgatgcgctcacggtcctgcgcgagtcactgctggcagggctgaatctggtgccggtagtgggcggcttcctttcctacctgggcgcgctgttcattcctgccgtcggaaactccgcagagcagctgtggcgtgagattgtcgacgcgcggatttccgaggcgctgttgcaattggtgaaggctgatctctttggcctcaccggggtagtgcagctgtacgccgatgcggtgcgctccggggacctggtagcgatcagcacgcagagcattgccgccaatacccagttcgtgggcgctgtgccccgcttcgcccaggtgggacaggaagtatccttgctccccctttacgtcattgccgcctcgctgcatcttgctttgctgcgcgacatggcattgaaggcggtcgacctgggttacacgccggcctatcgcagtacgctggaagcacaggccaaggactgcattgcccgttacaccgcgcatgttgaccgatacgtcgccgccgccatccaggcggccagggtgaacaatccctacgactggcgcaagggggattactacgagagcaacaagccgttgacgcagatgctgcaggtaaaggcagcactgcagatcgccgtcatcgacatgcgcgatacctggtatgcgttcgatccggtacgcttccccgcgccggtcgcggtccggctgaaccgcgaagttctctctccaatcatcggcaagtgggacaggaagaatatttcgccagacgccctgccgacgtggcagccgccggcatcgcggataaaagagctgggattgagcacattcagcacagccggcggtgcgtcatggctccagggaatccacgtcgtttaccaggatggatccgagctggaaaccggatctcgtgcgacccaaggcaagcgcttgttcctgcggaacacctcgttccatttgagcagggtcagggcgagatacctgcagggcattacgcgtctggaagtcgaccataacaacggaacgttctggcagggtggcggtcccaactccggcgccaatacagcctccatcagctacgcggggcatcgcgtgtcatccatcaggtcggtgggtcatggccgggcgcccgcgctgacctcagtgggcagccttatcgtgggcttccagttgctcaaccaggaggccgtcccgatcagtctgcagagctacgatcggctggcgcccaacatggcgccgcagttgctcagatggattgcggactga

SEQ ID NO: 153 - DNA, 2616 bp, Chryseobacterium Sp.
atgaattgtatttttattaataaaatgaaggctaaaaatgtgaaaattttatttgcgttttttattttgtctccttacgttttattttctcagcaacagcaaagattgataaccaattatattcttgcaaaacacgctcacgattttaaaaaatcagatttaagagattttcaaatcgataatatagatccatctgaatctttaaaaggagaaattgtaaaaattcaacaaaaattcaaaggatatcctgtttacaatgcagtaggaacagcgataattaaagaagataaaattgaatatttttcagattcttttgtgaaaaattataatactgcaacttcagaaacagcaacgctcaacaaagaaaaagcacttgggaatattgctgtagctttaggaaaagaagaaataaaaagctttcaaattcttgaaaatccatctttggaatcagctcataaaaactttgtaaaacaaagattaatgtatgctgatgtaaatgataatttgagacttgcctacgaattttcttttcaagagccaaaatcttcaaactattggaatattttggtagatgccaattcaggagaaattatttcaaaagacaacctgaatttatcctgtaattttcattcagatgcttattttggagaatctaggatttcaaataatatagaatctgcaaattttcaaaaaaactctttatttaaacttgcagataatgcgagttacaatgtttttgcattaccgattgaagctcctacttttggtaaccgatccattgtttcgaatccttggattttagcttcttcgccagcaggatggcattctacaggagcaacaagttacacaacgacaagaggaaataatgtgtattcttacgaagatacagcaaacaaagatgaacctgggttttctcccgatggaggtataaacagaaattttgatttccctttttctatgaacggaactccctcatctaaccgaagtgctgctatcacaaatttgttttatattaataacagagtacatgatattttttatcagttcggatttacagaatctgcaagaaactttcagcagaataatttcggtaaaggtggacaaggaaatgattatgttttggcagaatctcaagatggaagggctttaaataacgccaattttacaacaccttccgacggaaatagacctttgatgcaaatgtatctttggtctacagtcaacaggtatttcttttataacgcgccaattacagcaattccgagagttccacaagcaagtcctgctcaatttgggccactacttaatggaactggagttacaggtgatgttgttctggcttctacaattgatggctgctctgcattacctgcaggatctttaaccggaaaaataggattgatggaaaggggaggagcttcaggctgtacatttgctttaaaagtaaaaaacgctcaaaatgcaggtgctattgctgcaattatttataacaattctacagcaattaattttccttcttcaatgggcggaactgatgctacaattacaattccttcggttctgataacaaatgatgaaggtaaatttattaaaacacaagtcaataattcagtaacagtgaatgtcactttaaaaagtgatcccacaactgcaattacacctgatggaagctttgataatggtattgtaactcacgaatatggacacggaatttcaaataggctcacaggaaacggttatacctgtcttttaaaatctgcaagtaaagaacaaatgggtgaaggttggtcagatttttttgctttaatgttgaccaacaaacctggtgataatgccaatgttccaagaactgtaggaacttatgcaagtggacagtctacaaccggagcggggttcaggcctgcaaaatattctcccgatttttctattaataattacacttacggaaaaacaaacggtatggaaatcgaggaagatggtgcaatagttcccgatgtacatagtataggttttatttgggcatcgatgctttgggatcttcattggcaatatgttgcaaaatatgggtattcttcggatgttttagcaaataaaaacagtggaagtgcaagagttttacagttggtaacagatgcactgaaactgcaagcttgcaatcctacatttatcgatggacggaatgctattttgtctgctgaaatgctgactaccaaaggagaagaccgatgtatgatctggaagacttttgccaaaagaggattagggttgaatgctttggctggaaataaaatgaatattaacgatcaaaaagaagacttttcaatacctaaagattgtacagatggaaattcaaatattataattgataaaaatctcatagcgatttacccaaatcctgcaaaagatgaattttttatttacttaaaagattttaccatcggaaatcttcatctgcagatttatgacatgtccggaaaactgattgtttcagaaaacagatcatcacaagattctagaatttcggtctctacaaaggattttgaaaatggagtatatgttgtaaaacttcaaggaataggagttgacatcagttcaaggataattgtaaagaaataa

SEQ ID NO: 154 - DNA, 2616 bp, Chryseobacterium Sp.
atgaattgtatttttattaataaattgaaggctggaaatgtgaaaattctattttcgttttttattttgtttccttatttcatattttctcaacaacagaagaggttgatatccaattatatacttacaaaacaaagtaaggattttaaaaaagcagatttaagagattttgaaatcgataatatagattcatctgaatctctaaaaggagaaattgtaaaaattcaacaaaaatttaaaggacatcctgtttataatgctgtagggacagcgatcattaaaggtgataaaattgtatatttttcagattcttttgtaaaaaactatattgtttcgacttcagaaacggcaacgctcaacaaagaaaaagcacttgagaatattgctgtagctttagggaaagcagaaataaaaaactttcagattcttgaaaactcgctttcagaatcgaatccaaaaaatttcacgaaacaaaggttgatgtttgttgatgtgaatgataatttaagacttgcctacgaattctcttttcaggaaccacattctgcaaattattggaatgttttagtagatgctaattctggtgaaattatttcaaaagacaacctgaatttatcctgtaattttcattcagatgcgtattccggagaatctatggtttcaaatgatgtagaatcagcaaatcttcaaaaaaatgcttttctaaaacttgcagataatgcaagttacaatgtttttccactgccggttgaagcgcctacttttggcaatcgatccattgtttcaaatccttggattttggcttcttcaccggaaggatggcattctacaggagcaacaagttatacaacgacaagaggaaataatgtatatgcttacgaagatacagcagataaagatgaaccagggttttctcctgatggaggtgtaaacagaagtttcgatttccctttttctatgaacggtactccttcatttaatagaaatgccgcaatcactaatttattttatataaataataaagtacatgacattttttatcagttcggatttacagaatctgcaagaaattttcaacagaataatttcggtaaaggaggaaatggaaatgattatgttttggcagaatctcaagatggaggctctttaagcaatgccaattttacaacaccttccgacggaaacagacctgtgatgcaaatgtatatttggtcaacggtcaatagatatgttttttataatgctcctgtaacggcaattccgagaattccacaagcaagtcctgctcaatttggtccacagcttaatggaacaggcattacgggcgatgttgttttagcttctgtaattaatggttgttccgctttacctgcaggatctttagccggaaaaataggattgattgaaagaggaggagcttcaggctgtacatttgcttcaaaagtaaaaaacgcccaaaatgccggtgcaattgctgcgattatttataataatcctacggcgactaattttccttcttcaatgggcggaactgatgcaacaataacgataccttccgttctcattacgaatgacgaaggtgaatttgttaaaacacaactcaataatccagtaacggtaaatatcacgttaaaaagtgatcctgcaaccgcaattactcccgatggaagttttgacaacggaattattactcatgaatacggacacggaatttcaaacagattaacaggaaacggttacacttgtcttttaaaatccgcaagcaaagaacaaatgggtgaaggttggtcagatttttttgcattaatgttgaccaataaacccggagataacgcaaatgttccgagaagtgtgggaacttatgcaagtggacaatctacaaccggagccggattaagacagacaaaatactctcccgatttttctattaataattatacgtatggaaaaacaaacggaatggaaatcgaggaagatggcgaaatcgttcccgatgtacacagtataggatttatttgggcatcaatgctttgggatcttcattggcaatatgctgcgaaatatggttattcctctgatgttttagctaacaaaaacagtggaagcgcacgagttttacaacttgtaacagatgcattaaaactgcaggcttgtaatcctacctttattgacgggagaaatgcaattctttcagcagaaatgttgactactaaaggagaagaccgatgcatgatctggaaaacttttgctaaaagaggtttaggtttaaatgctttggctggaaataaaatgaatattaatgatcaaaaagaagatttttcaattcctaaagattgtttggaaggaaactcaaatattacgatagataaaagcttgatatcgatttatcctaatccggcaaaagatgaattctttatttatttaaaagatttcacgatcggaaatcttcatttgcagatttatgatatgtccggaaaattaattgtgtcagaaaacaaatcttcacaggattcaagaattcctgtttctacaaaagattttgaaaatggagtatatgtggtaaagctacagggaatcggagttgacatgagttcaaggataattgtaaagaaataa

SEQ ID NO: 155 - DNA, 2607 bp, Chryseobacterium Sp.
atgatcagaaactttattttgcacgtaaaatttaaaagaagtcagatcttacttcttgtttttgctttattaccactatcggcgttttctcaggatcacaaaagagttttacaaaattatatctcgacaaaacttaatcagagcttcaaaaaatctgatctcagagattttgaaatagataatgttgataaatctgaatccttaaacggagatattgtaaaaattcaacaaaaatttaaaggctatcctgtgtacaatgccgtcggaacagctttgataaaagacaataaagttctttactactcagattcattcattaaagattataattcttcggcatcattaacaactgcaataaataaagaaaaagcacttgaaaatattgctcttgctttaaataaaaatgaaatagcagattttcagattttagaaagttcttcccatgactcaggttataaaaatttcgttaagcagagattggttttctgggaattaaattcagatttaaaacttgcttatgaattttctttgcaggaacctgattctccaaactattggaatgttttagtggatgctaattcgggcaagattatttcgaaagaaaatttaaatatatcctgtaattttcattcagatgcctattcaagaggatcgggtgatattataaaacctcaaaatattcaggataatttttttaagttagcagataacgcaagttataatgtttttccattgccagtggaagcgccaactttcggaagtcgatctgttgtttcaaatccatggattttaagttcgtcacctgaaggatggcactcgacaggagctgcaaattatacgatcacaagaggaaacaatgtgtatgcttatgaagatacagcagataaaaatttgcccggtttttctcctgatggtggtgctgcaagaaattttgattttccattttcgataaacggaactcctactttcaacagaaacgcagccatcacgaatcttttttatattaataataaagtacacgatattttctacaaattcggatttacagaatccgccagaaattttcagcaaaataatttcggaaaaggagggattggaaacgattatgttttggcagaagcccaggatggtggtggtttgaataacgccaatttcacaactccttccgacggaaacagacctttgatgcaaatgtatctctggtcgactgtaaacaggtatttcttttataatgcgcccattacagcaattccgagaattccacaggcaagttctgcacaatttggcccgcaactcaacggaaccggagtcactggagatgttgttttagcctctgtgattgatggctgttcggatttaccttcaggttctttagcaggaaaaataggcttgattgaaagaggaggtgtaacaaactgtacattcgcttctaaagtgaaaaacgctcaagctgcaggagctgttgcggcaattatttacaataatccgactgctgcaaattttccttcttcaatgggcggaacagatactacaattacaattccttcagttttaattaccaatgacgaaggtgaatttattaaaacccagctcaataattcgttaactgtaaatgtaactttaaaaagtgatccggcaactgcactaacaccagacggaagttttgacaacggaattattactcacgaatacggacacggaatctccaatagattgacaggaaatggctatacctgtcttttaaaatctgcaagcaaagagcaaatgggagaaggctggtcagatttttttgctttaatgcttacaaataaaccgggcgatgatgcgagtgttccaagaagtatcggaacttatgcaagcggacaatctgtaagcggagcaggattcagacctacaaaatattcccctgatttttcaattaataattacacttacggtgataccaacggaatggaaattgaggaagatggcgaaattgttcccgatgtgcacagaattggttttatttgggcatcaatgctttgggatctgcattggcaatatgctgcaaaatacggctattcttcagatgtgacttcaagcataaacagcggaagtgcaagagttttacaattggtaaccgatgccttaaaattacagacttgtaaccctacatttatcgacggacgaaatgcaattttatctgctgaaatgctcacaaccaaaggagaagaccgttgtatgatctggaaaacctttgccagaagaggtttaggattaaatgctttgccgggaaataaaatgaatatcaatgatcaggtagaagatttttcgattcctaaagactgtaccgacggaaattcaaatgttcagccggataaaaatttaatatcaatttatccgaatccggcaaaagatgaattttttatttatttaaaagattttacgattggaagtcttcatctgcagatttacgatatctccggaaaattagtgctttctgaaaacagatcttcacaggatgcaagaattccggtttctaccaaagactttgagaacggagtatatattgtgaaaattcagggtatcggaattgattcctccacaaaaattatagtaaaaaaataa

SEQ ID NO: 156 - DNA, 2625 bp, Chryseobacterium Sp.
atgaattggacttttattaataagaaaaaaggaatgaatgttaaaacattgtttttgctttttattttccttctccttccttttattgttttttctcaacagcaaaaaaggttgattgcagattattttcaaacgaaacaaagtcagaattttaaaaaattagatttgctaaattttgacattgataatgtagattattcaaaatctttaggaggagaaattattaaaattcaacaaaaatttaaaggatatcctgtttataatgcagtaggaactactttaattaaggaaaataaaattttatatttctctgattctttcgtgaaaaattataattattcaacatcagatatacccttgctgagcaaagaatctgcattaagaaagattgctaatactttgcaaaataaagatttagagaactatcttattgtagaaagcactttatcagaaccacatcacaataaatatgcaacacaaaaattagtatttgtagaagtaaattcagccttaagacttgcctatcagttttttcttaccgaacaaaaatcttcaaactcctggaatattttggttgatgcaaatacgggagaaattataaacaaggataatctgaaattgtcttgcagttttcatccgggagcttttgggcatgatcattccagtgaaagtttaattaaaattcaaaacaaagaaagcaaatcatcttatttactttctccagataatgcctcttataatatatttcctctaccaattgagtcaccaacttttggaagcagatcggttgtcaataatccgtggattttagcttcatctccggaaggatggcattcagacggaagtaatcattatacgataacgagaggaaataatgtttacgcttatgaagattctgcaaattcaaatatgccgggatattctccagacggcggagtaaaccggaatttcaattttcctttttctatcaatggaacgcctgcttttaaccaaaatgcagcaattaccaatttattttatattaataatagagtacatgatattttttatcaattcggatttacagaatctgcaagaaattttcaacagaataattttggcaaaggcggtttaggaaacgattttgtaattgctgaagcacaggattctgaagatatcaataatgcaaattttacaactcctgctgatggaaataaacctgtgatgcaaatgtatctttggtcgcctgttaacagatattttttttacaatgctcctttatcagcggtttcgcgtgtcccgcaagctaattcagctcagttcggtccgcagcttaacggaatcggagtaacgggagatatagctttagcttctgtaattgatggttgttctgcattacctttgggatctttgtcagggaaaatcggacttgttgaaagaggaggaagttcttcctgtacatttgctttaaaagtgaaaaatgcgcaaaatgccggtgcagtggcagcaattatttataacaatccgactgctgtgaattttccatcttcaatgggtggcacagattctacaattacgattccgtctgttttaattaccaatagtgaaggtgaatatattaaaaatcagttgaatagcggaatcactgtcaatgtaacattaaaaagtgatcccgcaacagcagttacaccagatggaagttttgataacggaattattacccacgaatatggacatggaatatccaacagattaacaggaaacggatacacctgtcttttaaaatcccaaagtaaagagcaaatgggtgaaggttggtcagatttttttgctttaatgcttacaaacagtaccaatgacaatgcaactgtaccgagaagtataggaagttatgcaagcggacagtcaacagcaggattaggattcagacctgcaaaatattctcctgatttttctgtgaataattatacttatggaagaaccaacggaatggagtttgaagaagattctaaaattgttccagacgtacatagaataggatttgtctgggcaacaatgctttgggatctgcattggcaatacgctgcaaaatatggatattcctcagatgttactgctaatatgaatagtggaagttcccgtattttacaacttgttacaaacgctttaaaactacaggcttgtaacccaacttttattgatggtcggaatgccatattatctgcggaaatgcttactacaggcggaacagaccgatgcatgatctggaatacttttgcaaagagaggtttgggaatcaatgcttctgcaggaaataaaattgatattaatgatcaggttgaagatttttcaattcctaaagattgtttagaaggaaattcaaatatagcgatagacaaaagtaaaattcaaatctatcctaatcctgccagagaagagtttttcatttatttaaaagataataccataggaaatatatttgttcaggtttatgacatgacaggaaaattggtgttgtctgaaaacagatcttcgccagattccagaatttcaatttctacaaaagattttgaaaatggtgtttatgtgataaaattacaggctttaggcgtagatcttacctcgaaaataatagttaaaaagtaa

SEQ ID NO: 157 - DNA, 2613 bp, Chryseobacterium Sp.
atgggtagtaatactatttttttaaataaatcaaaaacgagaatttttctgtcagcatttttggctttttttccgataagtctttttgcgcaggaaaatgaaagattgataaaagagtatatcctgaaaaataaaatcagtgaattcaaaaaagcagatctgacgcattttaaaattgataatactgatttttcgcagtctttgaacggacaggtgatcaagatacagcagacctttaagggaattcctgtttacaattctttggctacagcttttattaaggacagaaaaattacttattttaatgatagctttgtgaaaagtttcacatcgtcttctgatgttgtaacgatttctccaaaaaacgcattagaaaaaattgcagcttcttttagcagaaatgaaatatcagattacatcatactgaatgattcggataaagagcccgatcataaaaattttgcaaaacaaaattttgtatacatcctttcaggttctgatttaagattatcccatcagtttttgttccatgatccgggaaattcaaaatactggaatgttttagttgatgcaacttcgggagaaattatttcaaaagaaaacctcactttagaatgtcattttcataaggatgcgtattctcataattccacgcacccgaatattatcatagaaaattctatggaaaaattaccatcaacgtttttggctgataatgcaaattataatgttttcccattgcctacagaagcacctacttttggcagcagaacgctggtttcaaatccgtggatcttatcttcttctcctgaaggatggcattctacaggaactgaaaaatatacggttacaagaggtaacaacgtctatgcttatgaagacagaaatgataaagatcagccgggatattctccggatggcggatcttccttaagctttaattttcctttttcaatcaacggaactccggattttaaccaaaatgcagcaattaccaatttgttttatactgcgaacagagtacacgatattttctatcagtttggttttacagaatcttccagaaattttcagcagaataattttggaaaaggcggtatcggaaatgattatcttctggctgaatctcaggatggaggcggattaaataatgccaattttactactccttctgatggaaaaaaaccggtaatgcagatgtatctttggtcaagagtcaacaggtatttttattataatgctcctatttctgcaattccgcgtattccgcaggcaagcgcagctcaatttggaccgcagctgaatggtataggtgtgacgggagatgtgatgctggcaaacgtgattgatggctgtactccgttaactccaaattctttagcaggaaaaataggtcttatagaaagaggaggcggaaccaactgtacttttgccctgaaagtgaaaaatgctcaggatgcaggagcggttgccgccattatttataataatccgggagccgtaaattttcctgcgtcaatgggcggaacagatgcttcaattaccatcccttcggttttgattaataacgctgaaggagaatatatcaaaacacagttgagcaattcaataacggtaaatgttactctcaaaagcgatcctgcaactgctgtaactcccgacggaagttttgataacggaatcattatccatgaatatggtcacggaattaccaacagattgaccggaaacggattcagttgcctttccaaggttcagagtaaagaacaaatgggggagggatggtcggatttttttgcattaatgttgaccaacactccaaatgctgatgcttccgttccaagaagtattgggtcttatgcaagtggtcagtctgcatcgggtttaggattcagacctgcaaaatactccccggatttttctgtaaacgattatacgtatgcagataccaacggaatggagtttgaggaagacggtgaacttgttcctgatgtacacagaataggttttgtatggggatcaatgctttgggatcttcattggcaatatgctgcaaaatatgggtattcatccgacgttaccgctaataaaaacagcggaagtgcaagagttttgcagcttgtgacagatgctttgaaattacagacctgcaatcctacatttattgatggaagaaatgccgtactgaatgctgaaatgcttactactggcggagaaaatcgttgcatgatatggaaaacttttgctaaaagaggtttaggtttgaatgcttccgctggaaataaaacgaatattaacgatcaggtagaagatttttctgttcctgcagactgtagagaaggcaatgcgaatgctgcaatagacaggagtttaatcaaaatttatcctaatcctgctaaagatgagttttttatatatttgaaagataataccattggtaagttatttgttcagatgtatgatatgtcaggaaaattggtgctttctgaggacagattttcacctgatgcgagaattcctgtttccacgaaagatattgaaaatggggtttatgttgtaagtgttcagggaataggagtagatttcagaacaaaaattattattaaaaaatag

SEQ ID NO: 158 - DNA, 2031 bp, Dyadobacter Sp.
gtgaaaataaaactttcccccaacaaacgcgtagtaagatttctggttttcacctcgattattctatctgtaagcagtcaattatttgcgcagcgtttcaattctgttgttttcagcaatcttccgcaagattaccagctgtatccaagaaatgcacatagcgatgggattattcccatttcaggcatcgtcgaagtgactggttacagttacgtctcgatacaggtttttcgcaacgatacgtttttcaaatacctgaaagccagccttaaatatgacagcaagggtacaggatcttttgcggcagaaaccagcataaaggcagaattggctcagtacagctttaaggtctttgcatgtaaaacaacagattcaacactgatcgtaaccaggaaaaatgttgtcagcggcgatgtttttatcgttgacggacagtcaaactcgactggtttttttgatgagtcgtccactgatccgtactgccggacctttggaaaaattactgatgtgctcaataccgcaccctataatccggcggatactctatgggcactttctaatcagcaaaaatatctgactggcgtcggaaccatgggttttgaaatacaaaaacagctttctcaaagatatggcattccgaactgtttgataaatggcggatttcactggtcttcctctgtgaatcatgcgcagcgcacggaaaataaccctgccgatctgaacacgggttatggacggctgttgtatagaattcaaaaagctggtttacagaatgcagttaagtcatttatttacagacagggagaatcggaagcttaccacgaaggttctgactggcccggaaatttcgaaaaaatacgaaataacctaaaattggattttccaaaactcgaacagatctatgttttccagatcgatattatctattttccttcaacaactggtgccgagcttagagagtatcagagaagattgcctgaacgatatcctgatgttcaatcgctggcgacagttggaacgaaacaattcgatgggttacattatggtccggaaggttacaggcaaaacggattagaagtttccagactaatcgccaaggatttttaccagttgggagatacgcttaatattaattctccctcattaaaaaaggtattttatacatctcaggagaaaaaacagttgattcttgtttttgacgaaggacaacagcttatctatcctgaaccttataaagtgagcgatcaggttacattgcatatgaaagactttatttatctgaatggtttccccgcggcagtgagcacggctcgggcagatggaaacagaattgtcctggactttgctaattcgcagaatgcttcaagattagactatcttccgccttacacgttggagacgaattatttctatccgtttaatggtccttatctgaccaataaactaggaatgcgtgcgttcacagttaataatttttctattgtagatggcctgaactctccaagtttaatatcctcggttaatccatttgcaaacgcagttttaagctggaatgagattaacggagcgacaagttatacgctcgaacggaaaatctccggagagaatgattacaagattatcggtaaattttcggcggcttccagaagctttgaagacaaaacaaacagtttcccgggaaagatctcataccgtctgaaagctggaaataacgtcgcagaatcatcttcatatgcctatgcggaagtggaaatcccggttgttttaggcttacaagaacctgtaaatgaattaattacagtatatcctaatccagcagctacccatcagcgcattacggttcgccctcaaaatctggtaaaaggttcgatccttctgatcaattccctaggtcaaactctgcaaaggaaagagataactcatcagacagaggccggctttattattgcggatttacctgcaggaacttactttattcaattacaaacagaaaacaaatcactgacgaaaaaactttctgttgttcggtag

SEQ ID NO: 159 - DNA, 2946 bp, Pseudomonas Sp.
atgaccgagcaacccttctcccttctacgcaacctggcccgaaccgggaacgacacgcacgaacatggcgatgacacgttatcgttcatcaacgcgatggaaaaactgaacatccattcagtgttcgatatcgtacggcgctccaaaagcgcttttgttcacgaactctcacgcatcagtgatgctgatgcagcgctcgcctatgaaaacgctcgttgttacgccacccagatcgtgcgcctgtatcgcaatcaactgctgtcttcaggccgaacccaacagctgacacggcgcaccggcgtgcgttcgctggtagacatcgggcctggcttccctaatctgttcaaggagaactgggatctgttttgcaaggtgggtgcaatcgaggccaaggattcacccgttgcgtacctgacgtccttgtatcgttttgctctggaacagctggaaggcagcgtggcggaaccgagccgaatcaagctcgacgaacgacggcctgacctcaaggatctgttgatcgatcaacaaagcaccttcacgccagtgcctacgctgcacatcgtcaatcaggtgttaagtaaagccatcaacgcctacgtgggcacagtgcctgaggacaagggcaagactatttaccaattggtggccgaaaaacaacacccgtttcagtttccttacaactttcactttcaacagatcagccttgggcttgacgggaagaaaccaacgctcggcgagctgagttaccgcgtcagccttgaagttccaaccacgtcaagatacggcagtgactatgggaaagtgcagcactccagtgccattgcacaggtgctgatgagcggagcaggcccagagcaacaggcaatcgtgcttgaacctgccttatccagtcaggcaaacgccgacgcgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgctataggcaaccacacggcctatgcctctcccaacatcctgtcagcgggacacaccgcggatgaagactccccacgcgaggcacgcctgacagcaatcaaggctcgattcggagctggctacgtcaatggcccgaccactcagccggcaatggctctgaacaaggatgcgtacggcattaagcggctggtcaacaccagcgtggaccgcttcgaccgcctgcaacgcatgatccgtctgcagcgctggacgggcattccttttacagcgctggacacgttggtcatggccgtcgttcgctccgaaggcgccgtgaaccctcagatggtgctgacggtaaatacgctacgcgcactgggaacctatcggtatctgaacaaacgttacggtctcgcgccggatgagtttgcagcctttgttcaccagatgcccggcgaggcaaacgacggacgcttgccgatgttcgaccgggtattcaacaacccggcattgttcgataccccgctggtgctggatgggtcgactctctacctcgatcagcacagtagccagcacgtcaaagctcgcgctcaattgagccgagccttgcatttatccagcactcaagagggcctgaggcagctggccatcgatgttcgcgaactgattggcaacgcgcccactgacttcagactcaacttgagcatgatctcttcgctgtaccgccaagcccgcattgcttcgatgttcggtctgaccaccgcggaatgccgggcattgatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaacgatgcgcgcctggctgtactgaagggagaccagctggcatcccttgacttgccaagcaaggatgaccaaaacaacaccctcaattggtgggctatcctctattaccacctgatcgacggatttgggctggtcacgactcagccgctggacgaggaacctgcggtcagcatccgccgcaccctgcatgaacgcttgtcctcaatagccatcgcggaaccccttgcaagcgaagtcgaagccaaacttgaaacgttcgtattgaacggctatcggaatcagcatcggctggtggaagagctgttgctgaccctcaccggtttgccgccggaccgttgcgagccggtgatatgctgggcaggcagtgacgtaagcaagtttctcgctgcattacttcgagataatggcgtcattcagacgctgtcgacgctgattcgatattcagaagtcagccagcaactggggctgagcgcccgggcactgcgcacttttttgatcaattcacgctggctgtacgcagactcggaaggcccgttttatctctcaccgaacagtctgtatttgctcgaccgttacagcaactggcgcgacaactgcggttacccggaggaagcgctgctcgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaagtggactggttaagccggatgcacagcgccagtgatgtcaccggcctttcggcaagacaattactgtcggctactgacctgacagcgaccagcacggcctcgcactggaagtccgtaggcgaagccgtgatagccgccaaccgttaa

SEQ ID NO: 160 - DNA, 2946 bp, Pseudomonas Sp.
atgaccgagcaccccttctccctgttacgcaacctggcccgatccgggaacgatacgcacgaacatggcgatgacacgttatcgttcatcaacgcgatggaaaaactgaacatccattcagtgttcgatatcgtacggcgctccaaaggcgcttttgttcacgaactctcacgcatcagtgatgctgatgcagcgctcgcctatgaaaacgctcgctgttacgccacccagatcgtgcgcctgtatcgcaatcaactgctgtcttcaggccgaacccaacagctgacgcggcgcaccggcgtgcgttcgctggtagacatcgggcctggcttccctaatctgttcaaggagaactgggatctgttttgcaaggtgggtgcaatcgaggccaaggattcacccgttgcgtacctgacgtccttgtatcgttttgctctggaacagctggaaggcagcgtggcggaaccgagccgaatcaagctcgacgaacgacggcctgacctcaaggatctgttgatcgatcaacaaagcaccttcacgccagtgcccacgctgcatatcgtcaatcaggtattaagtaaagccatcaacgcctacgtgggcacagtgcctgaggacaagggcaagactatttaccaattggtggccgaaaaacaacacccgtttcagtttccttacaactttcactttcaacagatcagccttgggcttgacgggaagaaaccaacgctaggcgagctgagttaccgcgtcagccttgaagttccaaccacgtcaagatacggcagtgactatgggaaagtgcagcactccagtgccattgcacaggtgctgatgagcggagcaggcccagagcaacaggcaatcgtgcttgaacctgccttatccagtcaggcaaacgccgacgcgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgctataggcaaccacacggcctatgcctctcccaacatcctgtcagcgggacacaccgcggatgaagactccccacgcgaggcacgcctgacagcaatcaaggctcgattcggagctggctacgtcaatggcccgaccactcagccggcaatggctctgaacaaggatgcgtacggcattaagcggctggtcaacaccagcgtggaccgcttcgaccgcctgcaacgcatgatccgtctgcagcgctggacgggcattccttttacagcgctggacacgttggtcatggccgtcgttcgctccgaaggcgccgtgaaccctcagatggtgctgacggtaaatacgctacgcgcactgggaacctatcggtatctgaacaaacgttacggtctcgcgccggatgagtttgcagcctttgttcaccagatgcccggcgaggcaaacgacggacgcttgccgatgttcgaccgggtattcaacaacccggcattgttcgataccccgctggtgctggatgggtcgactctctacctcgatcagcacagtagccagcacgtcaaagctcgcgctcaattgagccgagccttgcatttatccagcactcaagagggcctgaggcagctggccatcgatattcgcgaactgattggcaacgcgcccactgacttcagactcaacttgagcatgatctcttcgctgtaccgccaagcccgcattgcttcgatgttcggtctgaccaccgcggaatgccgggcattgatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaacgatgcgcgcctggctgtactgaagggagaccagctggcatcccttgacttgccaagcaaggatgaccaaaacaacaccctcaattggtgggctatcctctattaccacctgatcgacggatttgggctggtcacgactcagccgctggacgaggaacctgcggtcagcatccgccgcaccctgcatgaacgcttgtcctcaatagccatcgcggaaccccttgcaagcgaagtcgaagccaaacttgaaacgttcgtattgaacggctatcggaatcagcatcggctggtggaagagctgttgctgaccctcaccggtttgccgccggaccgttgcgagccggtgatacgctgggcaggcagtgacgtaagcaagtttctcgctgcattacttcgagataatggcgtcattcagacgctgtcgacgctgattcgatattcagaagtcagccagcaactggggctgagcgcccgggcactgcgcacttttttgatcaattcacgctggctgtacgcagactcggaaggcccgttttatctctcaccgaacagtctgtatttgctcgaccgttacagcaactggcgcgacaactgcggttacccggaggaagcgctgctcgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaagtggactggttaagccggatgcacagcgccagtgatgtcaccggcctttcggcaagacaattactgtcggctactgacctgacagcgaccagcacggcctcgcactggaagtccgtaggcgaagccgtgatagccgccaaccgttaa

SEQ ID NO: 161 - DNA, 2943 bp, Pseudomonas Sp.
atgaccgagcaacccttctcccttctacgcaacctggcccgaaccgggaacgacacgcacgaacatggcgatgacacgttaccgttcatcaacgcgatggaaaaacttaacatccattcagtgttcgatatcgtacggcgctccaaaagcgcttttgttcacgaactctcgcgtatcagtgatgctgatgcagcgctcgcctatgaaaacgctcgctgttacgccacccagatcgtgcgcctgtatcgcaatcaactgctgtcctcaggccgaacccaacagctgacgcggcgcaccggcgtgcgttcgctggtagacatcgggcctggcttccctaatctgttcaaggagaactgggacctgttttgcaaggtgggtacaatcgaggccaaggattcgccagtggcgtacctgacgtccttgtaccgctttgcgctggaacagctggaaggcagcgtggcggaaccgagccgaatcaaactcgatgaacgacggcctgacctcaaggatctgttgatcgatcaacaaagcaccttcacgccagtgcctacgctgcatatcgtcaatcaggtgttaagtaaagccatcaacgcctacgtggacacggtgcctgaagacaagggcaagactatttaccaattggtggccgagaaacaacacccgtttcagtttccttacaactttcactttcaacagatcagccttgggcttgacgggaagaaaccaacgctaggcgagctgaattaccgcgtcagccttgaagttccaaccacgtcagggtacggcagtgactatgggaaagtgcagcactccagtgccattgcacaggtgctgatgagcggagcaggcccggagcaacaggcaatcgtgcttgaacctgccttatccagtcaggcaaacgccgacacgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgccatcggcagccacacggcctatgcctctcccaacatcctgtcagcgggacacaccgcggatgaagactccccacgcgaggcaagtctgacagcaatcaaggctcgattcggagctggctacgtcaatggcccgaccactcagccggcaatggctctgaacaaggatgaatacggcattgagcggctggtcaacaccagcgtggaccgcttcgaccgcctgcaacgcatgatccgtttgcagcgctggacgggcattccttttacagcgctggacacgttggtcatggcggtcattcgctccggaggcgccgtgaaccttcagatggtgctgacggaaaatacgctacgcgcactgggaacctatcggtatctgaacaaacgttacggcctcgcgccggaagagtttgcagtctttgttcaccagatgcccggcgaggcaaacgacggacgcttgccgatgttcgaccgggtattcaataaccctgcattgttcgataccccgctggtgttggatgggtcgattctcgacctcgatcaggacagtagcgagcacgtcaaagctcgcgctcaattgagccgagccttgcatttatccagcactcatgagggcctgaggcagctggccatcgatgttcgcgaactgattggtaacgcgcccactgacttcagactcaacttgagcatgatctcttcgctgtaccgccaagcccgcattgcttcgatgttcggtctgaccaccgcgcaatgccgggcattgatcgacctgctaggctctctgtcttttcggaaaaaggtggtctcaggtcaactcgacgacaccgaaccggacgtgctcgatatcctgatgcacctggactgggcagtcacatggctcgaagcgtctgatcgagacgtcaccacactgcgacgtcaggcaggctgggacatgaccgaaacaacagtcacgcaggagctgactgttcagcttgagcaattaaccaatgatgcgcgcctggctgtagtgaacagcgaccagctggcatcccttgacttgccaagcaaggatgaccaaaacaacaccatcaattggtggttaatcctctcttacctgatcgacgaatcagggctggtcaggactctgccgctgcacgaggaacccgcggtcagcatccgtcgcaccctgcatgaacgcttgtcctccatagacatcgcggaaccccttgcaagcgaagtcgaagccagacttgcaacgttcgtattgaacggctatcggaatcaacatcggctggtggaagaactgttgctgaccctcaccggtttgccgccggaccgttgcgagccggtgatacgttgggcaggcagcgacgtaagcaagtttctcgctgcgttactttgggataatggcgtcattgagacactctcgacgctgattcgctattcagaagtcagccagcaactggggctgagcgcccgggcactgcgcacttttttgatcaatccaagctggctgtacgcaggctcagaaggccagttttatctctcaccgaacagtctgtatttgctcgaccgttacagcaactggcgcgaccactgcggttacccggaggaagcgctgctcgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaggtggactggttaagccggatgcacagcgccagtgacgtcaccggcctttcggcaagacaattactgtcggctactgacctgacagcgaccagcacggcctcgcactggaagtccgtaggcgaagccgtgatagccgccaaccgttaa

SEQ ID NO: 162 - DNA, 2964 bp, Pseudomonas Sp.
atgaccactggagcgccggacatgaccgagcaacccttctcccttctacgcaacctggcacgaaccgggaacgacacgcacgaacatgacgatgacaaattgtcgttcatcaacgcgatggaaaaactgaacatccattcagtgttcgatatcgtacggcgctccaaaagcgcttttgttcacgaactctcacgtatcagtgatgctgatgcagcgctcgcctatgaaaacgctcgctgttacgccacccagatcgtgcgcctgtatcgcaatcaactgctgtcctcaggccgaacccaacagctgacgcggcgcaccggcgtgcgttcgctggtagacatcgggcctggcttccctaatctgttcaaggagaactgggatctgttttgcaaggtgggtgcaatcgaggccaaggattcacccgttgcgtacctgacgtccttgtaccgctttgcgctggaacagctggaaggcagcgtggcggaaccgagccgaatcaagctcgatgaacgccggcctgacctcaaggatctgttgatcgatcaacaaagcaccttcacgccagtgcctacgctgcatatcgtcaatcaggtattaagtaaagccatcaacgcctacgtggacacggtgcctgaggacaagggcaagactatttaccaattggtggccgagaaacaacacccgtttcagtttccttacaactttcactttcaacagatcagccttgggcttgacgggaagaaaccaacgctaggcgagctgagttaccgcgtcagccttgaagttcccgccacgtcaagattaactagtgactatggaaaagtgcagcactccagtgccattgcacaggtactgatgagcggagcaggcccggagcaacaggcaatcgtgcttgaaacggccttatccagtcaggcaaacgccgacacgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgccatcggcagccacacggcctatgcctctcccaacatcctgtcagcgggacacaccgcggatgaagactccccacgcgaggcaagtctgacagcaatcaaggctcgattcggagctggctacgtcaatggcccgaccactcagccggcaatggctgtgaacaaggatgaatacggcattgagcggctggtcaacaccagcgtggaccgcttcgaccgcctgcaacgcatgatccgtctgcagcgctggacgggcattccttttacagcgctggacacgttggtcatggcggtcattcgctccgaaggcgccgtgaaccctcagatgatgctgacggtaaatacgctacgcgcactgggaacctatcggtatctgaacaaacgttacggcctcgcgcctgatgagtttgcagcctttgttcaccagatgcccggcgaggcaaacgacggacgcttgccgatgttcgaccgggtattcaacaacccggcattgttcgataccccgctggtgctggatgggtcgattctcgacctcgatcaggacagtagtcagcacgtcaagactcgcgctcagttgagccgagccttgcatttatccagcactcatgagggcctgaggcaactggccattgatgttcgcgaactgattggcaacgcgcccactgacttcagactcaacgtcagcatgatctcttcgctgtaccgccaagcccgcattgcttcgatgttcggtctgaccactgcggaatgccgggcattgatcgacctgctaggctctctgtcttttcggaaaaaggtggtctcaggtcaactcgacgacagcgaaccggacgtgctcgatatcctgatgcaactggactgggcagtcaaatggctcgaagcgtcttatcgagacgtcgccacactgcgacgtcaggcaggctgggacatgaccggaacaatagtcacgcaggaactgactgttcagcttgagcaattaaccaatgatgcgcgcctggctgtattgaacagcgaccagctggcatcccttgatttgccaagcaaggatgaccaaaacaacaccatcaattggtggttaatcctctcttacctgatcgacgaatcagggctggtcacgactcagccgctgcacgaggaacccgcggtcagcatccgccgcaccctgcatgaacgcttgtccgccatagccatcgcggaaccccttgcaagcgaagtcgaagccagacttgcaacgttcgtattgaacggctatcggaatcagcatcggctggtggaagagctgttgctgaccctcaccggtttgccgccggaccgttgcgagccggtgatacgctgggcaggcagcgacgtaagcaagtttctcgctgcgttactttgggataatggcgtcattcagacactctcgacgctgattcgctattcagaagtcagccagcaactggggctgagcgcccgggcactgcgcacttttttgatcaatccaagctggctgtacgcaggctcagaaggccagttttatctctcaccgaacagtctgtatttgctcgaccgttacagcaactggcgcgaccactgcggttacccggaagaagcgctgctcgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgctttcaacatgcacgaggtggactggttaagccggatgcacagcgccagtgacgtcaccggcctttcggcaagacaattactgtcggctactgacctgacagcgaccagcacggcctcgcactggaagtccgtaggcgaagccgtgatagccgccaaccgttaa

SEQ ID NO: 163 - DNA, 3015 bp, Pseudomonas Sp.
ctgacacttttgtcagctagacgcgagcgccacggtaaacaaggctgtgtcatgaccactggagcgccggacatgaccgagcaacccttctcccttctacgcaacctggcccgaaccgggaacgacacgcacgaacatggcgatgacacgttaccgttcatcaacgcgatggaaaaacttaacatccattcagtgttcgatatcgtacggcgctccaaaagcgcttttgttcacgaactctcgcgtatcagtgatgctgatgcagcgctcgcctatgaaaacgctcgctgttacgccacccagatcgtgcgcctgtatcgcaatcaactgctgtcctcaggccgaacccaacagctgacgcggcgcaccggcgtgcgttcgctggtagacatcgggcctggcttccctaatctgttcaaggagaactgggacctgttttgcaaggtgggtacaatcgaggccaaggattcgccagtggcgtacctgacgtccttgtaccgctttgcgctggaacagctggaaggcagcgtggcggaaccgagccgaatcaaactcgatgaacgacggcctgacctcaaggatctgttgatcgatcaacaaagcaccttcacgccagtgcctacgctgcatatcgtcaatcaggtgttaagtaaagccatcaacgcctacgtggacacggtgcctgaagacaagggcaagactatttaccaattggtggccgagaaacaacacccgtttcagtttccttacaactttcactttcaacagatcagccttgggcttgacgggaagaaaccaacgctaggcgagctgaattaccgcgtcagccttgaagttccaaccacgtcagggtacggcagtgactatgggaaagtgcagcactccagtgccattgcacaggtgctgatgagcggagcaggcccggagcaacaggcaatcgtgcttgaacctgccttatccagtcaggcaaacgccgacacgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgccatcggcagccacacggcctatgcctctcccaacatcctgtcagcgggacacaccgcggatgaagactccccacgcgaggcaagtctgacagcaatcaaggctcgattcggagctggctacgtcaatggcccgaccactcagccggcaatggctctgaacaaggatgaatacggcattgagcggctggtcaacaccagcgtggaccgcttcgaccgcctgcaacgcatgatccgtttgcagcgctggacgggcattccttttacagcgctggacacgttggtcatggcggtcattcgctccggaggcgccgtgaaccttcagatggtgctgacggaaaatacgctacgcgcactgggaacctatcggtatctgaacaaacgttacggcctcgcgccggaagagtttgcagtctttgttcaccagatgcccggcgaggcaaacgacggacgcttgccgatgttcgaccgggtattcaataaccctgcattgttcgataccccgctggtgttggatgggtcgattctcgacctcgatcaggacagtagcgagcacgtcaaagctcgcgctcaattgagccgagccttgcatttatccagcactcatgagggcctgaggcagctggccatcgatgttcgcgaactgattggtaacgcgcccactgacttcagactcaacttgagcatgatctcttcgctgtaccgccaagcccgcattgcttcgatgttcggtctgaccaccgcgcaatgccgggcattgatcgacctgctaggctctctgtcttttcggaaaaaggtggtctcaggtcaactcgacgacaccgaaccggacgtgctcgatatcctgatgcacctggactgggcagtcacatggctcgaagcgtctgatcgagacgtcaccacactgcgacgtcaggcaggctgggacatgaccgaaacaacagtcacgcaggagctgactgttcagcttgagcaattaaccaatgatgcgcgcctggctgtagtgaacagcgaccagctggcatcccttgacttgccaagcaaggatgaccaaaacaacaccatcaattggtggttaatcctctcttacctgatcgacgaatcagggctggtcaggactctgccgctgcacgaggaacccgcggtcagcatccgtcgcaccctgcatgaacgcttgtcctccatagacatcgcggaaccccttgcaagcgaagtcgaagccagacttgcaacgttcgtattgaacggctatcggaatcaacatcggctggtggaagaactgttgctgaccctcaccggtttgccgccggaccgttgcgagccggtgatacgttgggcaggcagcgacgtaagcaagtttctcgctgcgttactttgggataatggcgtcattgagacactctcgacgctgattcgctattcagaagtcagccagcaactggggctgagcgcccgggcactgcgcacttttttgatcaatccaagctggctgtacgcaggctcagaaggccagttttatctctcaccgaacagtctgtatttgctcgaccgttacagcaactggcgcgaccactgcggttacccggaggaagcgctgctcgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaggtggactggttaagccggatgcacagcgccagtgacgtcaccggcctttcggcaagacaattactgtcggctactgacctgacagcgaccagcacggcctcgcactggaagtccgtaggcgaagccgtgatagccgccaaccgttaa

SEQ ID NO: 164 - DNA, 2946 bp, Pseudomonas Sp.
atgaccgagcaacccttctcccttctacgcaacctggcccgaaccgggaacgacacgcacgaacatggcgatgacacgttatcgttcatcaacgcgatggaaaaactgaacatacattcggtgttcgatatcgtacggcgatccaaaagcgcttttgttcacgaactctcacgtatcagtgatgctgatgcagcgctcgcctatgaaaacgctcgctgttacgccacccagatcgtgcgcctgtatcgcaatcaactgctgtcttcaggacgaacccaacagctgacgcggcgcaccggcgtgcgttcgctggtagacatcgggcccagcttccccaatcttttcaaggaaaactgggatctgttttgcaaggtgggtgcgatagaagccaaggattcgcccgttgcgtacctgacgtccttgtatcgttttgctctggaacagctggaaggcagcgtcgcggaggacagccgaatcaaactccatgaccgacggcctgatctcaaaggtctgttgatcgaccaacaaagcaccttcacgccaatccccacgctgcacatcgtcaatcaggtgttaagtaaagccatcaatgcctacgtggacacggtgcctggggacaagggcaagtctatttaccaattggtggccgaaaaacaacacccgtttcagtttccttacaacttccactttcaacagatcagcctcgggcttgccgggaagaagccaatgttaggcgagctgaattactgcgtcagccttgaacttccaaccacttccaggtacggcagtgactatggaaaagtgcagcactccagtgccatcgcacaggtgctgatgagcggagcaggcccagagcaacaggcaatcgtgattgaacctgccttatccagtctggcaaacgcagacacgtcagcagacctgacccgtcagttcttcaaaacgaaatacaacgtcgattacgtcgacgacgccagcaatcctttgaataatctgaacgtcttcctggagaagacgggtctggacagtgacggagtcgaagccctgcttgccataggcaaccacacggcctatgcctctcccaacatccgttcagcgggaaacaccgcagatgaagactccccactcgatgcgagcctgacagcaatcaaggcccgattcggagctggctacgtcaatggcccgaccactcagccggcaatggctctgaacaaggatgcgtacggcattgagcggctggtaaacaccagcgtggaccgcttcgaccgtctgcaacgcatgatccgtctgcagcgctggacgggcattccgtttacagcgctggacacgttggtcatggcggtcattcgctccgaaggcgccgtgaatctgcagatggtgctgacggtaaatacgctacgcgcactgggaacctatcggtatctgaacaaacgttacggcctcgcgcctgatgagtttgcagcctttgttcacctgatgcccggcgaggcaaacgacggacgcttgccgatgttcgaccgggtattcaacaacccggcattgttcgatactccgctggtgctggatgggtcgattctcgacctcgatcaggacagtagccagcacgtcaagactcgcgctcagttgagccgagccctgcagttatccagcactcatgaaggcttgaggcagctggccgtcgatgttcgccaactgattggcaacgcgcccactgacttcagactcaatttgagcatgatttcttcgctgtaccgccaagcccgcattgcttcgatgttcggtctgaccgcagcagaatgccgggcattgatcgacctgctgggcactctgtcttttcggaaaaaggtggtctcaggtcaactcgacgacaccgaaccggacgtgctcgatatcctgatgcaactggactgggcagtcacgtggctcaaagcgtctgaccgagacatcgctgcactgcgacgtcagctaggctgggacatcaccgaaacgatagtcacgcaggaactgactgttcaacttgagcaattgaccaacgatgcgcgccaggctgtactgaagagagaccagctggcatcccttgacttgccaagcaaggatgaccaaaacaacaccatcaattggtggactatcctcgattacgacctgatcgacggattagggctggtcacgactcagccgctgcacgaggaacccgcggtcagcatccgccgcaccctgcatgaacgcttgtcctccatagccatcgcggaaccccttgcaagcgaagtcgaagccagacttgaaacgttcgtattgaacggctaccggaatcaacatcggctggtggaagggctgttgctgaccctcaccggtttgccgccggaccgttgcgagccggtgatacgctgggcaggcagcgatgcaggcaagtttctcggtgcgttactttggcatggtggcgccattcagacgctctcgacgctgattcgctattcagaagtcagccagcaactggggctgagcgcccgggcattacgcacatttttaatcagtccacgctggctgcatgcagactttggcttcctgcttcccctttcaatgaacaatctgtatttgctcgaccgttaccgcaactggcgcgacaactgcggttacccggaagaaacgctgctcgattatttcaagcaagccaatgacacgcatcgagacaatacccaatgtgctgcgcggctggcgtcactgacaggctggacgtcatctgaagtgctggccgcaaacgcattgctgaccgggtcagatcgtatcgcttccagcatgcacgaggtggactggttgagccggatgcacagcgccagtgatgtcaccggcctttcggcaagacaattactgtcggctactgacctgacagcgaccagcactgcctcgcactggaagtcagtaggcgaagccgtgatagccgccaaccgttaa

SEQ ID NO: 165 - DNA, 2946 bp, Pseudomonas Sp.
atgaccgagcaacccttctcccttctacgcaacctggcccaaaccgggaacgacacgcacgaacatggcgatgactcgttatcgttcatcaacgcgatggaaaaactgaacatccattcagtgttcgatatcgtacggcgatccaaaagcgcttttgttcacgaactctcacgtatcagtgatgctgatgcagcgctcgcctatgaaaacgctcgctgttacgccacccagatcgtgcgcctgtatcgcaatcaactgctgtcttcaggccggccccagtcagtgacacggcgcaccggcgtgcgttcactggtagacatcgggcccagcttccccaatcttttcaaggaaaactgggatctgttttgcaaggtgggtgcgatagaagccaaggattcgcccgtggcgtacctgacgtccttgtaccggtttgctctggaacagctggaaggcagcgtcgcggaggacagccgaatcaaactccatgaccgacggcctgatctcaaaggtctgttgatcgaccaacaaagcaccttcacgccagtgcctacgctgcacatcgtcaatcaggtgttaagtaaagccatcaatgcctacgtagacacagtgcctgaggacaagggcaagtctatttaccaattggtggccgagaaacaacacccgtttcagtttccttacaacttccactttcaacagatcagcctcgggcttgccgggaagaagccaatgttaggcgagctgaattactgcgtcagccttgaacttccaaccacttccaggtacggcagtgactatggaaaagtgcagcactccagtgccatcgcacaggtgctgatgagcggagcaggcccagagcaacaggcaatcgtgattgaacctgccttatccagtctggcaaacgcagacacgtcagcagacctgacccgtcagttcttcaaaacgaaatacaacgtcgattacgtcgacgacgccagcaatcctttgaataatctgaacgtcttcctggagaagacgggtctggacagtgacggagtcgaagccctgcttgccataggcaaccacacggcctatgcctctcccaacatccgttcagcgggaaacaccgcagatgaagactccccactcgatgcgagcctgacagcaatcaaggcccgattcggagctggctacgtcaatggcccgaccaatcagccggcaatggctctgaacaaggatgcgtacggcactgagcggctggtaaacaccagcgtggaccgcttcgaccgtctgcaacgcatgatccgtctgcagcgctggacgggcattccgtttacagcgctggacacgttggtcatggcggtcattcgctccgaaggcgccgtgaacctgcagatggtgctgacggtaaatacgctacgcgcactgggaacctatcggtatctgaacaaacgttacggcctcgcgcctgatgagtttgcagcctttgttcacctgatgcccggcgaggcaaacgacggacgcttgccgatgttcgaccgggtattcaacaacccggcattgttcgatactccgctggtgctggatgggtcgattctcgacctcgatcaggacagtagccagcacgtcaagactcgcgctcagttgagccgagccctgcagttatccagcactcatgaaggcttgaggcagctggccgtcgatgttcgcgaactgattggcaacgcgcccactgacttcagactcaatttgagcatgatttcttcgctgtaccgccaagcccgcattgcttcgatgttcggtctgaccgcagcagaatgccgggcattgatcgacctgctgggcactctgtcttttcggaaaaaggtggtctcaggtcaactcgacgacaccgaaccggacgtgctcgatatcctgatgcaactggactgggcagtcacgtggctcaaagcgtctgaccgagacatcgctgcactgcgacgtcagctaggctgggacatcaccgaaacaatagtcacgcaggaactgactgttcaacttgagcaactaaccaacgatgcgcgccaggctgtattgaagagagaccagctggcatcccttgacttgccaagcaaggatgaccaaaacaacaccatcgattggtggactatcctacattactacctgatcgacggattagggctggtcacgactcagccgctgcacgaggaacccgcggtcagcatccgccgcaccctgcatgaacgcttgtcctccatagccatcgcggaaccccttgcaagcgaagtcgaagccagacttgaaacgttcgtattgaacggctaccggagtcaacatcggctggtggaagggctgttgctgaccctcaccggtttgccgccggaccgttgcgagccggtgatacgctgggcaggcagcgatgcaggcaagtttctcggtgcgttactttgggatgatggcgccattcagaaggtctcgacgctgattcgctattcagaagtcagccagcaactggggctgagcgcccgggcattacgcacatttttaatcagtccacgctggctgcatgcagactttggcttcctgcttcccctttcaatgaacagtctgtatttgctcgaccgctaccgcaactggcgcgacaactgcggttacccggaagaaacgctgctcgattatttcaagcaagccaatgacacgcatcgagacaatacccaatgtgctgcgcggctggcgtcactgacaggctggacgtcatctgaggtactggccgcaaacgcattgctgaccgggtcagatcgtatcgcttccagcatgcacgaggtggactggttgagccggatgcacagcgccagtgatgtcaccggcctttcggcaagacaattactgtcggctactgacctgacagcgaccagcactgcctcgcactggaagtcagcaggcgaagccgtgatagccgccaaccgttaa

SEQ ID NO: 166 - DNA, 2925 bp, Pseudomonas Sp.
atgacccagcaccccttctccctgttacgaaacctggccagatccgggaacgagacgcacgaacatgacgatgacacgttatcgttcatcaacgcgatggaaaaactgaacatacattcagtgttcgatatcgtacggcgctccaaaagcgcttttgttcacgaactctcacgcatcagtgatgctgatgcagcgctcgcctatgaaaacgctcgctgttacgccacccagatcgtacgcctgtatcgcaatcaactgctgtcttcaggccgaacccaacagctgacgcggcgcaccggcgtgcgttcgctggtagacatcgggcctggcttccctaatctgttcaaggagaactgggatctgttttgcaaggtgggtgcaatcgaggccaaggattcgccagtggcgtacctgacgtccttgtatcgttttgctatggaacagctggaaggcagcgtggcggaaccgagccgaatcaaactcgatgaacgacggcctgacctcaaggatctgttgatcgatcaacaaagcaccttcacgccagtgcctacgctgcatatcgtcaatcaggtgttaagtaaagccatcaacgcctacgtggacacggtgcctgaagacaagggcaagactatttaccaattggtggccgagaaacaacacccgtttcagtttccttacaactttcactttcaacagataacgctggggctggcaggcaaaaagccgatgctcggtgagctgagttatcacgtcagccttgaagttccggcgacctcgacgccgactgacgagtttggaaaagtgcagcaatccagcgccatcgcacaggcgctgatgagcggtttaagtcctgaacaacaggcaatcgtgcttgaacctgcactgacgactcagccggaagtcatcattccgttcttcaaaaccaaatacaacatcgcttactcagacgacgccagcaatccgctcaatagccttgataccttcatggccaagaccgagctcgacagcgatgccgtggaagcacttcttgccatgggcggtcatacgccttacccctcgcccaatatccaatcggctggacaaattgccggggggaagccgtcacatgatgaaggcgctgctgcaatcgtgagtcgctttggggctggatacgtcaatggcacagccgccgatccagcgatggggcttcgcaaggacattgatggtgtcgtatacctgaccaacaccagcgtggaccgtttcgaccgcctgcaacgcatgatccgcctgcagcgctggacaggcatttctttcacagcgctggacacgttggtcatggccgtcattcgctccgaaggcgccgtgaaccctcagatggtgctgacggtaaatacgctgcgcgcactgggaacctatcggtatctgaacaaacgttacggcctcgcgcctggtgagtttgcagcctttgttcaccagatgcccggcgaggcaaacgacggacgcttgccgatgttcgaccgggtattcaacaaccctgcattgttcgataccccgctggtgctggatgggtcgattctcgacctcgatcaggacagtagcgagcacgtcaaagctcgcgctcaattgagccgagccttgcatttgtccagcactcatgagggcctgaggcaactggccatcgatgttcgcgaactgattggcaacgcgcccactgacttcagactcaacgtcagcatgatctcttcgctgtaccgccaagcccgcattgcttcgatgttcggtctgaccactgcgcaatgccgggcattgatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaacgatgcgcgcctggctgtagtgaacagcgaccagctggcatcccttgatttgccaagcaaggatgaccaaaacaacaccatcaattggtggttaatcctctcttacctgatcgacgaatcagggctggtcaggactcagccgctgcacgaggaacccgcggtcagcatccgccgcaccctgcatgaacgcttgtccgccatagccatcgcggaaccccttgcaagcgaagtcgaagccagacttgcaacgttcgtattgaacggctatcggaatcagcatcggctggtggaagagctgttgctgaccctcaccggtttgccgccggaccgttgcgagccggtaatacgctgggcaggcagcgacgtaagcaagtttctcgctgcgttactttgggataatggcgtcattcagacactctcgacgctgattcgctattcagaagtcagccagcaactggggctgagcgcccgggcactgcgcacttttttgatcaatccacgctggctgtacgcaggctcagaaggccagttttatctctcaccgaacagtctgtatttgctcgaccgttacagcaactggcgcgacaactgcggttacccggaggaagcgctgcttgagtatttcaagcaagccaatgacccgcagcgagacgctacacaatgtgctgcgcggctggcgtcactgacaggctggacgtcatctgaagtgctggccgcaaacgcattgctgaccgggtcagatcgtatcgcttccagcatgcacgaagtggactggttaagccggatgcacagcgccagtgatgtcaccggcctttcggcaagacaattactgtcggctaccgacctgacagcgaccagcacggcctcgcactggaagtccgtaggcgaagccgtgatagccgccaaccgttaa

SEQ ID NO: 167 - DNA, 2925 bp, Pseudomonas Sp.
atgacccagcaccccttctccctgttacgaaacctggccagatccgggaacgatacgcacgaacatgacgatgacacgttatcgttcatcaacgcgatggaaaaactgaacatacattcagtgttcgatatcgtacggcgctccaaaagcgcttttgttaacgaactctcacgcatcagtgatgctgatgcagcgctcgcctatgaaaacgctcgttgttacgccacccagatcgtgcgcctgtatcgcaatcaactgctgtcttcaggccgaacccaacagctgacgcggcgcaccggcgtgcgttcgctggtagacatcgggcctggcttccctaatctgttcaaggagaactgggatctgttttgcaaggtgggtgcaatcgaggccaaggattcgccagtggcgtacctgacgtccttgtatcgttttgctatggaacagctggaaggcagcgtggcggaaccgagccgaatcaaactcgatgaacgacggcctgacctcaaggatctgttgatcgatcaacaaagcaccttcacgccagtgcctacgctgcatatcgtcaatcaggtgttaagtaaagccatcaacgcctacgtggacacggtgcctgaagacaagggcaagactatttaccaattggtggccgagaaacaacacccgtttcagtttccttacaactttcactttcaacagataacgctggggctggcaggcaaaaagccgatgctcggtgagctgagttatcacgtcagccttgaagttccggcgacctcgacgccgactgacgagtttggaaaagtgcagcaatccagcgccatcgcacaggcgctgatgagcggtttaagtcctgaacaacaggcaatcgtgcttgaacctgcactgacgactcagccggaagtcatcattccgttcttcaaaaccaaatacaacatcgcttactcagacgacgccagcaatccgctcaatagccttgataccttcatggccaagaccgagctcgacagcgatgccgtggaagcacttcttgccatgggcggtcatacgccttacccctcgcccaatatccaatcggctggacaaattgccggggggaagccgtcacatgatgaaggcgctgctgcaatcgtgagtcgctttggggctggatacgtcaatggcacagccgccgatccagcgatggggcttcgcaaggacattgatggtgtcgtatacctgaccaacaccagcgtggaccgtttcgaccgcctgcaacgcatgatccgcctgcagcgctggacaggcatttctttcacagcgctggacacgttggtcatggccgtcgttcgctccgaaggcgccgtgaaccctcagatggtgctgacggtaaatacgctgcgcgcactgggaacctatcggtatctgaacaaacgttacggcctcgcgcctggtgagtttgcagcctttgttcaccagatgcccggcgaggcaaacgacggacgcttgccgatgttcgaccgggtattcaacaaccctgcattgttcgataccccgctggtgctggatgggtcgattctcgacctcgatcaggacagtagcgagcacgtcaaagctcgcgctcaattgagccgagccttgcatttgtccagcactcatgagggcctgaggcaactggccatcgatgttcgcgaactgattggcaacgcgcccactgacttcagactcaacgtcagcatgatctcttcgctgtaccgccaagcccgcattgcttcgatgttcggtctgaccactgcgcaatgccgggcattgatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaatgatgcgcgcctggctgtagtgaacagcgaccagctggcatcccttgatttgccaagcaaggatgaccaaaacaacaccatcaattggtggttaatcctctcttacctgatcgacgaatcagggctggtcaggactcagccgctgcacgaggaacccgcggtcagcatccgccgcaccctgcatgaacgcttgtccgccatagccatcgcggaaccccttgcaagcgaagtcgaagccagacttgcaacgttcgtattgaacggctatcggaatcagcatcggctggtggaagagctgttgctgaccctcaccggtttgccgccggaccgttgcgagccggtgatacgctgggcaggcagcgacgtaaacaagtttctcgctgcgttactttgggataatggcgtcattcagacactctcgacgctgattcgctattcagaagtcagccagcaactggggctgagcgcccgggcactgcgcacttttttgatcaatccacgctggctgtacgcaggctcagaaggcccgttttctctttcaccgaacagtctgtatttgctcgaccgttacagcaactggcgcgacaactgcggttacccggaggaagcgctgcttgagtatttcaagcaagccaatgacccgcagcgagacgctacgcaatgtgctgcgcggctggcgtcactgacaggctggacgtcatctgaagtgctggccgcaaacgcattgctgaccgggtcagatcgtatcgcttccaacatgcacgaggtggactggttaagccggatgcacagcgccagtgacgtcaccggcctttcggcaagacaattactgtcggctactgacctgacagcgaccagcacggcctcgcactggaagtccgtaggcgaagccgtgatagccgccaaccgttaa

SEQ ID NO: 168 - DNA, 2943 bp, Pseudomonas Sp.
atgaacgagcaacccttctccctattacgcaacctggcccgatccggggacaatacgcacaagcatgacgatggccaggtatcgttcatcgacgcgatggaaaaactgaatgtacattcagtgttcgatatcgtacggcgctccaaaaccgcctttgttcgcgaactctcacgcatcagtgacgctgatgcagcgctcgcctatgaaaacgctcgttgttacgccactcagatcgtgcgcctgtatcgcaatcaactgctgtcttcaggccgaacccaacagctgacgcggcgcaccggcgtgcgttcgctggtagacatcgggcctggctttcccaatcttttcaaggaaaactgggatctgctttgcaaggtgggtgcgatagaagcgaaggattcgccggtagcatacctgacgtccttgtaccgcttcgctctggaacagctggaaggcagcattgcggaagacagccgaatcaaactccatgaccgacggcctgacctcgaagatctgttgatcgatcaacaaagcaccttcacgccaatccccacgctgcacatcgtcaatcaagtgttaagtaaagccatcagcgcctacgtggacacggtgccagctgacaagaataagtctatttaccaattggtggccgagaaacaacacccgtttcagtttccttacaactttcactttcaacagatcagccttgggcttgccgggaagaagccgacgttaggcgagctgagttaccgcgtcagccttgaagttccaaccacgtcagggtacggcagtgactatggaaaagtgcagcactccagtgccattgcacaggtgctgatgagcggagcaggcccagagcaacaatcaatcgtgcttgaacctgccctatccagtcaggcaaacgccgacacgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgccataggcagccacacggcctatgcctcccccaacatcctgtcagcgaaacacaccgcggatgaagactccccactcgaggcaagcctgaaagcaatcaaggcccgattcggagctggctacgtcaatggcccgaccactcagccggcaatggctacaagcaaggatgcatacggcattgagcgactgataaacaccagcgtggaccgcttcgaccgcctgcaacgcatgatccgtctgcagcgctggacaggcattcctttttcagcgctggacacgttgatcatggcggtcattcgctccgaaggcagcgtcaaccttccgatggtgctgacggttaatacgctacgcgcactgggaacctatcggtatctcgacaaacgttacggtcttgcgcctgatgagtttgcagcctttgttcaccttatggccggcgaggcaaacgatgggcgcttgccgatgttcgaccgggtcttcaacaacccggcattattcgataccccactggtattgagcgggtcaattctttacctcgatcatgacagtagccagtacgtcaaggctcgcgctcagttgagccgagccttgcatttatccagcactcatgagggcctgaggcagctggccattgatgttcgcgaactgattggcaacgcgcctactgacttcagactcaatttgagaatgatctcttcgctgtaccgccaaacccgcatcgcttcgatgctcggtctgaccgctttagaaagcagggcattgatcgacctgctcggcagtgagtcttatcggaaaaaggtgatctcaggtcaactcgacgacaccgaaccggacgtgctcgatatcctgatgcaactggactgggcagtcacgtggctcaaagcttctgatcgagacatcgccacactgcgacgtcagataggctgggacatgaccgaaacaatagtcacgcaggagctgactgttcagcttgagcaattaaccaacgatgcgcgccaggctgtattgaagagagaccagttggcatcccttgacttgccaagcaaggatgaccaaaacaatgctatcacctggtggaatattctccatgtcctgatcgacttatcagggctggtcataccccagccgctggccgaagacccagcgttcagcatccgcagaaccctccatgagcgcttgtctcatatcgcgatcggggaaccccttttaaccgaaatcgaagccagacttgcaacgttcatattgaacggctacctcaatcaacatcgattgatggaagggttgttgctgaccctgaccggtttgccgctggaccgttgcgaaccggtcatacgctgggcaggcagcgacgtaagcaaattcctgggtgagttactgctgggtaaaggcgtcattcagacgctcacgaaactgattcgctattcagaagtcagccagcaactggggctaagcgcccgggcattacgcacgtttttgatcaatccacgctggctgtatccagaagttggcttcctgcttcccctttcaatgaacagtctgtatttgctcgaccgttaccgcgactggcgcgacaactgcggttacccggaagaagcgctgctcgagtatttcaagcaagccaatgacacgcctcgagacaatacgcaatgtgctgcgcggctggcgtcactgacaggctggacgtcatctgaagtactggccgcaaacgcattgctgacggggtcagatcgtatcgcttccaacatgcacgaagtggactggttgagccggatgcacaacgccagcgatgtcaccggcctctcggcaaaacaattactgtcggctactgacctgacagcgaccagcactgcctcgcactggaagtccgtaggcgaagccgtgatagccgccaaccgttaa

SEQ ID NO: 169 - DNA, 2997 bp, Pseudomonas Sp.
ctgacacttttgtcagctagacgcgagcgccatggtaaacaaggctgggtcatgaccactggagagccggacatgaccgagcaccccttctccctgttacgcaacctggcccgatccgggaacgacacgcacgaacatggcgatgacacgttatcgttcatcaacgcgatggaaaaactgaacatccattcagtgttcgatatcgtacggcgctccaaaggcgcttttgttcacgaactctcacgcatcagtgatgctgatgcagcgctcgcctatgaaaacgctcgttgttacgccacccagatcgtgcgcctgtatcgcaatcaactgctgtcttcaggccgaacccaacagctgacgcagcgcaccggcgtgcgttcgctggtagacatcgggcctggcttccctaatctgttcaaggagaactgggatctgttttgcaaggtgggtgcaatcgaggcaaaggattcacccgttgcgtacctgacgtccttgtatcgctttgctctggaacagctggaaggcagcgtagcggaaccgagccgaatcaagctcgatgaacgacggcctgacctcaaggatctgttgatcgatcaccaaagcaccttcacgccagtgcctacgctgcatatcgtcaatcaggtgttaagtaaagccatcaacgcctacgtgggcacagtgcctgaggacaagggcaagactatttaccaattggtggccgaaaaacaacacccgtttcagtttccttacaactttcactttcaacagataacgctggggctggcaggcaaaaagccgatgctcggtgagctgagttatcacgtcagccttgaagttccggcgacctcgacgccgactgacgagtttggaaaagtgcagcaatccagcgccatcgcacaggcgctgatgagcggtttaagtcctgaacaacaggcaatcgtgcttgaacctgcactgacgactcagccggaagtcatcattccgttcttcaaaaccaaatacaacatcgcttactcagacgacgccagcaatccgctcaatagccttgataccttcatggccaagaccgagctcgacagcgatgccgtggaagcacttcttgccatgggcggtcatacgccttacccctcgcccaatatccaatcggctggacaaattgccggggggaagccgtcacatgatgaaggcgctgctgcaatcgtgagtcgctttggggctggatacgtcaatggcacagccgccgatccagcgatggggcttcgcaaggacattgatggtgtcgtatacctgaccaacaccagcgtggaccgcttcgaccgcctgcaacgcatgatccgtctgcagcgctggacgggcattccttttacagcgctggacacgttggtcatggccgtcattcgctccgaaggcgacgtgaaccctcagatggtgctgacggtaaatacgctgcgcgcactgggaacctatcggtatctgaacaaacgttacggcctcgcgcctggtgagtttgcagcctttgttcaccagatgcccggcgaggcaaacgacggacgcttgccgatgttcgaccgggtattcaacaaccctgcattgttcgataccccgctggtgttggatgggtcgattctcgacctcgatcaggacagtagcgagcacgtcaaagctcgcgctcaattgagccgagccttgcatttatccagcacccatgagggcctgaggcaactggccatcgatgttagcgaactgattggcaacgcgcccactgacttcagactcaacgtcagcatgatctcttcgctgtaccgccaagcccgcattgcttcgatgttcggtctgaccactgcgcaatgccgggcattgatcgacctgctaggctctctgtcttttcggaaaaaggtggtctcaggtcaactcgacgacaccgaaccggacgtgctcgatatcctgatgcaactggactgggcagtcacatggctcgaagcgtctgatcgagacgtcaccacactgcgacgtcaggcaggctgggacatgaccgaaacaatagtcacgcaggaactgactgttcagcttgagcaattaaccaatgatgcgcgcctggctgtagtgaacagcgaccagctggcatcccttgatttgccaagcaaggatgaccaaaacaacaccatcaattggtggttaatcctctcttacctgatcgacgaatcagggctggtcaggactcagccgctgcacgaggaacccgcggtcagcatccgccgcaccctgcatgaacgcttgtccgccatagccatcgcggaaccccttgcaagcgaagtcgaagccagacttgcaacgttcgtattgaacggctatcggaatcagcatcggctggtggaagagctgttgctgaccctcaccggtttgccgccggaccgttgcgagccggtgatacgctgggcaggcagcgacgtaaacaagtttctcgctgcgttactttgggataatggcgtcattgagacactctcgacgctgattcgctattcagaagtcagccagcaactggggctgagcgcctgggcactgcgcacttttttgatcaatccacgctggctgcatgcagactttggcgggctgcttcccctttcaatgagcagtctgtatttgctcgaccgttatcgcaactggcgcgacaactgcggttacccggaagaagcgctgctcgagtatttcaagcaagccaatgacacgcctcgagacaatacccaatgtgctgcgcggctggcatcactgacaggctggacgtcatctgaagtgctgaccgcaaacgcattgctgaccgggtcagatcgtatcgcttccagcatgcacgaggtggactggttaagccggatgcacagcgccagtgatgtcaccggcctttcggcaagacaattactgtcggctaccgacctgacagcgaccagcacggcctcgcactggaagtccacaggcgaagccgtgatagccgccaaccgttaa

SEQ ID NO: 170 - DNA, 3015 bp, Pseudomonas Sp.
ctggcacttttgtcaggtagacgcgagcgccatggtagacaaagctgggtcatgatcactggagagccagacatgaacgagcaacccttctccctattacgcaacctggcccgatccggggacaatacgcacaagcatgacgatggccaggtatcgttcatcgacgcgatggaaaaactgaatgtacattcagtgttcgatatcgtacggcgctccaaaaccgcctttgttcgcgaactctcacgcatcagtgacgctgatgcagcgctcgcctatgaaaacgctcgttgttacgccactcagatcgtgcgcctgtatcgcaatcaactgctgtcttcaggccgaacccaacagctgacgcggcgcaccggcgtgcgttcgctggtagacatcgggcctggctttcccaatcttttcaaggaaaactgggatctgctttgcaaggtgggtgcgatagaagcgaaggattcgccggtagcatacctgacgtccttgtaccgcttcgctctggaacagctggaaggcagcattgcggaagacagccgaatcaaactccatgaccgacggcctgacctcgaagatctgttgatcgatcaacaaagcaccttcacgccaatccccacgctgcacatcgtcaatcaagtgttaagtaaagccatcagcgcctacgtggacacggtgccagctgacaagaataagtctatttaccaattggtggccgagaaacaacacccgtttcagtttccttacaactttcactttcaacagatcagccttgggcttgccgggaagaagccgacgttaggcgagctgagttaccgcgtcagccttgaagttccaaccacgtcagggtacggcagtgactatggaaaagtgcagcactccagtgccattgcacaggtgctgatgagcggagcaggcccagagcaacaatcaatcgtgcttgaacctgccctatccagtcaggcaaacgccgacacgtcggcagacctgacccgccagttcttcaaaacgaaatacaacgttgattacgtcgacgacgccagcaatcctttgaataatctgaacgtcttcctggagaagacgggtctggacagcgacggagtcgaagcccttcttgccataggcagccacacggcctatgcctcccccaacatcctgtcagcgaaacacaccgcggatgaagactccccactcgaggcaagcctgaaagcaatcaaggcccgattcggagctggctacgtcaatggcccgaccactcagccggcaatggctacaagcaaggatgcatacggcattgagcgactgataaacaccagcgtggaccgcttcgaccgcctgcaacgcatgatccgtctgcagcgctggacaggcattcctttttcagcgctggacacgttgatcatggcggtcattcgctccgaaggcagcgtcaaccttccgatggtgctgacggttaatacgctacgcgcactgggaacctatcggtatctcgacaaacgttacggtcttgcgcctgatgagtttgcagcctttgttcaccttatggccggcgaggcaaacgatgggcgcttgccgatgttcgaccgggtcttcaacaacccggcattattcgataccccactggtattgagcgggtcaattctttacctcgatcatgacagtagccagtacgtcaaggctcgcgctcagttgagccgagccttgcatttatccagcactcatgagggcctgaggcagctggccattgatgttcgcgaactgattggcaacgcgcctactgacttcagactcaatttgagaatgatctcttcgctgtaccgccaaacccgcatcgcttcgatgctcggtctgaccgctttagaaagcagggcattgatcgacctgctcggcagtgagtcttatcggaaaaaggtgatctcaggtcaactcgacgacaccgaaccggacgtgctcgatatcctgatgcaactggactgggcagtcacgtggctcaaagcttctgatcgagacatcgccacactgcgacgtcagataggctgggacatgaccgaaacaatagtcacgcaggagctgactgttcagcttgagcaattaaccaacgatgcgcgccaggctgtattgaagagagaccagttggcatcccttgacttgccaagcaaggatgaccaaaacaatgctatcacctggtggaatattctccatgtcctgatcgacttatcagggctggtcataccccagccgctggccgaagacccagcgttcagcatccgcagaaccctccatgagcgcttgtctcatatcgcgatcggggaaccccttttaaccgaaatcgaagccagacttgcaacgttcatattgaacggctacctcaatcaacatcgattgatggaagggttgttgctgaccctgaccggtttgccgctggaccgttgcgaaccggtcatacgctgggcaggcagcgacgtaagcaaattcctgggtgagttactgctgggtaaaggcgtcattcagacgctcacgaaactgattcgctattcagaagtcagccagcaactggggctaagcgcccgggcattacgcacgtttttgatcaatccacgctggctgtatccagaagttggcttcctgcttcccctttcaatgaacagtctgtatttgctcgaccgttaccgcgactggcgcgacaactgcggttacccggaagaagcgctgctcgagtatttcaagcaagccaatgacacgcctcgagacaatacgcaatgtgctgcgcggctggcgtcactgacaggctggacgtcatctgaagtactggccgcaaacgcattgctgacggggtcagatcgtatcgcttccaacatgcacgaagtggactggttgagccggatgcacaacgccagcgatgtcaccggcctctcggcaaaacaattactgtcggctactgacctgacagcgaccagcactgcctcgcactggaagtccgtaggcgaagccgtgatagccgccaaccgttaa

SEQ ID NO: 171 - DNA, 2772 bp, Pseudomonas Sp.
atgcaaaccgacaacagcccgttgctcgctcaactgattgatcactcacgcccgcccgctcccggtcgggacgatttcaagaccgccctgcggcgcctcaacattcactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgcctcccgcgtcttcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggttcccatgttgtcgatcgtcaaccagatcctgctcaaaaatatcgcgcaagccaaagaagaagatacctataaggtgctgagtgaaacctggtacccgttttctctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacactgctgaaaagtagctgggtagccgaaacgggcgcgaaagcgttctatcacaactattacaactggaagtctgatctgatcggaccggcaaaactcactgactttctgagccacacacaactggatgccgaccagcttcaggcactgcttgcactacagactcagtcaccacgccaatcgcctaactgcaagcaaaaaaccagcctcagctacggtgcgtgctacatcaacggcacgaccacacccgctatcagcctggacaacgccaagctgaccaacatcagccttgagcgctttgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagtttgctgcctggcttcatcaattacccgttcatgcctcaggcgaccgcgtgtcattgttcgaccaggtatttaatcgcaccgggtctgccctgccgcccctgtatctggacagtgccaggttcgacgataccacccggcaacagctctgcgctgggttgggcctgcaagacacccaggattcgcttcaactactgatcaaccccaacaagcctgcaacccgtacgatcgagacagtcagcgagatctatcggcaagcaagaatcgctcgcctgtttggggtatcggtcgtggaatgccgacaactggtgcaaatgctcgggaatgcgaaccttctcatgcagttgcgcaacccaacgttacgcaacaaaccgaagggcatgactgactttctcgatgtgctcatgcaactggaatgggccagccgttggtttaaagaaaacggcagcagcctggcgttgctcagatgccaactattgctggatcgccaggtccaggacccggtcatcaatcagctattgaaggagttcgccctctatgaccaagcgtccctttccaaagcgttgcaaccgcttgatcttcctcagcaacccattgacgaaaaagaccgtttacccgccgttgactgggaagccttggcctatacggcgctgcaacagatgcgtcccagtaacaacatcgagacagcgctcgatcacgtgctctcttccgttcaaatcagcacggcgcctgcccgtacgacacagttgatcaaccaaactaagtccaagctccacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcaccgctgcaaaccctcagttatctgatactgctgttacctcacgccgccgatattctgcaacttcccctcagctcacaagcacttcaccagttcctggtcaatccgcactggctcgcgcgcaagtacaagatgccctcgctgcttgaactgaccccgtacaacctctacctcatgcagcagttcaaacactgcatccaccactgcggcctgacggaagagcagcttctgaactacttcgaacacgccaatgccctgcccaacagcactgcgcaaaacaccagcgaagacacgaacgagcatctcgctcaacttttaggttggagtgccagtgaaatcgatgtgttcagcaaccaactcaaacctccacgcattacctcaatgaaccgcctggactgggtgctgcgctgccgccgagccagcatcgacacaggcctgcctgccaacatgctgattaaagccagcgaactgaaagccgactctgcgtttgctgactggaagagcgtcggtgaggcgatcaccagtgcgtatccataa

SEQ ID NO: 172 - DNA, 2772 bp, Pseudomonas Sp.
atgcaaaccgacaacagcccgttgctcgctcaactgattgatcactcacgcccgcccgctcccggtcgggacgatttcaagaccgccctgcggcgcctcaacatccactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgcctcccgcttcttcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggctcccatgttgtcgatcgtcaaccagatcctgctcaaaaatatcgcgcaggccaaagaagaagatacctataaggtgctgagtgaaacctggtacccgttttctctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacactgctgaaaagtagctgggtaaccgaaacgggcgcgaaagcgttctatcacaactattacaactggaagtctgatctgatcggaccggcaaaactcactgattttctgagccacacacaactggatgccgaccagcttcaggcactgcttgcactacagactcagtcaccacgccaatcgcctaactgcaagcaaaaaaccagcctcagctacggtgcgtgctacatcaacggcacgaccacacccgctatcagcctggacaacgccaagctgaccaacatcagccttgagcgctttgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagtttgctgcctggcttcatcaattacccgttcatgcctcaggcgaccgcgtgtcattgttcgaccaggtatttaatcgcaccgggtctgccctgccgcccctgtatctggacagtgccaggttcgacgataccacccggcaacagctctgcgctgggttgggcctgcaagacacccaggattcgcttcaactactgatcaaccccaacaagcctgcaacccgtacgatcgagacagtcagcgagatctatcggcaagcaagaatcgctcgcctgtttggggtatcggtcgtgggatgccgacaactggtgcaaatgctcgggaatgcgaaccttctcatgcagttgcgcaacccaacgttacgcaacaaaccgaagggcatgactgactttctcgatgtgctcatgcaactggaatgggccagccgttggtttaaagaaaacggcagcagcctggcgttgctcagatgccagctattgctggatcgccaggtccaggacccggtcatcaatcagctattgaaggagttcgccctctatgaccaagcgtccctttccaaagcgttgcaaccgcttgatcttcctcagcaacccattgacgaaaaagatcgtttacccgccgttgactgggaagccttggcctatacggcgctgcaacagatgcgtcccagtaacaacatcgagacagcgctcgatcacgtgctctcttccgttcaaatcagcacggcgcctgcccgtacgacacagttaatcaaccaagcaaagtccaagctccacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcgccgctgcaaaccctcagttatctgatactgctgttacctcacgccgccgatattctgcaacttcccctcagctcacaagcacttcaccagttcctggtcaatccgcactggctcgcgcgcaagtacaagatgccctcgctgcttgaactgaccccgtacaacctctacctcatgcagcagttcaaacactgcatccaccactgcggcctgacggaagagcagcttctgaactacttcgaacacgccaatgccctgcccaacagcactgcgcaaaataccagcgaagacacgaacgagcatctcgctcaacttttaggttggagtgccagtgaaatcgatgtgttcagcaaccaactcaaacctccacgcattacctcaatgaaccgcctggactgggtgctgcgctgccgccgagccagcatcgacacaggcctgcctgccaacatgctgattaaagccagcgaactgaaagccgattctgcgtttgctgactggaagagcgtcggtgaggcgatcaccagtgcgtatccataa

SEQ ID NO: 173 - DNA, 2781 bp, Pseudomonas Sp.
atggttgaacgctcgaatgcccttcatcagcacacgccggcattacagttggtggacccgcgcggcttgcctgtggggtcaattgcgctatgccgtacgagtagcgatatcgagccgcaaatccttaccagccatgcgtcattcgacatggcggggcgacctgtcagctgttgggattcgcgcctgtgggctgatcgggcgcccgccaatctcagcgtcattcattcgctcagcggtcaggtgctggccagtgacagcgtcgatgctggctggcgagtgtcgttagcgggggaggccgggcaggcgctggtggtctgggacgctcggggcgttgtgcgacgcatcgggtacgacgcgttgctcaggcccatcgaggtttttgaagatgagcactgcgttgggcgccttctctatggcggccctgattcgactgatcacaaccagtgtggtcagttgattcgtcatgacgatccggcaggcacgcggcttgacgatgcgtatggtctttcgggaaatgtgatcaggcaaacgcggcgctttctgcactctgccgatgagcctgactggcccgagtcgctgaccgggcgtgatgccttgctggagcccggtgacggcgcaaccacgtgctggcaatacaacccgctgagcgagatcacctggcaacgcgatgcgcagggcaatgttcagtgtctgggttacaccgttgcagggcagttgaaagacagtcgtttacagctcaacggtcaggccgaacaggttctggtcagtgccatccagtatgacgcgcaggggcgggtggtgtcggaaacggctggcaatggtgtgatcagcacggcgctctatgccgctgaagacggtcgcctgggggaattgaataccacgcgtagtaatgggcagtcgttgcaggatttgcgttacgactatgacccggtcggtaatgtaatccgtgtcgatgatcgtgctctgccagccatctccaaaggtcagcgcatcggctcggtttcgacctatcgatacgacacgctttatcaactgatcgaagcctcgggcagggaatgggcagtcgttaatcacggcccggtgctgcctggtttccagagtcccgccgatccttcgacgctggctgattacacgcagacgtatcgctacgatgccggcggcaacctgcagcagcttacccatacaggcacgcagtcccattcgcgcacgctggtcaccgcacgttgcagcaaccgcagtctgccggtgatcaatggccacatacctgacgaagcagaaattgctgctgccttcgatgccaacggtaatctgcttgcgctgcaagccgggcaaaacctgagctgggaccgacgcaaccagttgcagcacgtgcgccccgttatccgtgaaaatggtatggacgacagcgaacgctatagctacgacgccagcggccagcgcctgcgcaaggtgcgtaccacgcaagccaaaaccattacccatacggccgatgtgcgttacctgcccggtcttgaaatccgtaccgatacggccactggtgaaaccctgcatgttgttgtggcccaggccgggcgtaataacgtgcgcgtgctgcattgggcgtctggaaagcccgacgcgcttgaaaatgatcagactcgttacaccctgaacgaccacctggggtccggcacgctggaactggatgggcaggcgcagcgtgtcagccacgaacgttattacccgttcggcggcacgtcatggtgggcggggcgcaatgcgatcgatgcgagttacaagaccgtgcgttactcgggcaaggagcgcgatgcgacagggctttattattacggtttgcggtattacgcgccgtggttacagcgctggatcaatccggacccggccggtcttgaggacgggcttaatttatacggtatgttgagaaacaacccgctcacgttcatcgacgcggtgggaggagtcgctgaaattcccaagcatattcactacatctggttgggcgctgctgaaccgctgatggagcacctggaagggatcaaaaacacttctgtgctgaatcccgactatcagttgacgctgcatctgcatctggacctgcgaaaaggtgatgaaacggaaatagcctcagcgctgcgcgggcgaagaaacgtccatatttccgacatcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcagggataccgatttcattaccaagcccaagaggattttcacgatgcgcccgacggacacaccttggagccgggatgaaatcgtgattaacaataactcgttcgcgtcacctgccaacaatccggtgctgagcactttggaaaaggagatagtcgaccggtacagcgtttatcgtgagacaggccttggcaaggtgctcagtagcaccgccgatgttagagacaggatgagaatcgtttctgctgtcacggggcccaaggtgttcacagaggtattgcttaaagaggggcgtgggctaagaaagctgttttcaacaatggtcaattaccatgttaaaggtgaaaaattaaaaaacccgaagcgttatcaggcagaagcccaaaaaagaatgccactctcgaacttcataaaaatgggaggcagccactcatggcaatag

SEQ ID NO: 174 - DNA, 2787 bp, custom Sp.
atggttgaacgctcgattgcccttcatcagcacacgccggcattacagttggtggacccgcgcggcttgcctgtggggtcaattgcgctatgccgtacgagtagcgatatcgagccgcaaatccgtaccagccatgcgtcattcgacatggcggggcgacctgtcagctgttgggacccgcgcctgtgggctgatcgggcacccgccaatctcagcgtcattcattcgctcagcggtcaggttctggccagcgacagtgtggacgcgggctggcaggtgttgttggcgggtgaggccgggcaggtgctggaggcctgggacgctcggggcgttgtgcgacgtacggggtatgacgcgctgctaaggcccatcaaggtttttgaagatgagcactgcgttgagcgcttgctttacggcggccctgattcgagcacgtataaccagtgcggtcagttgattcgtcatgacgatccggcaggcacgcggcttgacgatgcgtatggtctttcgggaaatgtgatcaggcaaacgcggcgctttctgcactctgccgatgagcctgactggcccgagtcgctgaccgggcgtgatgctttgctggagcccggtgacggcgcaaccacgtgctggcaatacaacccgctgagcgagatcacctggcaacgcgatgcgcagggcaatgttcagtgtctgggttacaccgttgcagggcagttgaaagacagtcgtttacagctcaacggtcaggccgaacaggttctggtcagtgccatccagtatgacgcgcaggggcgggtggtgtcggaaacggctggcaatggtgtgatcagcacggcgctctatgccactgaagacggtcgcctgggggaattgaataccacgcgtagtaatgggcagtcgttgcaggatttgcgttacgactatgacccggtcggtaatgtaatccgtgtcgatgatcgtgctctgccagccatctccaaaggtcagcgcatcgactcggtttcgacctatcgatacgacacgctttatcaactgatcgaagcctcgggcagggaatgggcagtcgttaatcacggcccggtgctgcctggttttcagagtcccgccgatccttcgacgctggctgattacacgcagacgtatcgctacgatgccggcggcaacctgcagcagcttacccatacgggcacgcagtcccattcgcgcacgctggtcaccgcacgttgcagcaaccgcagtctgccggtgatcaatggccacatacctgacgaagcagaaattgctgctgccttcgatgccaacggtaatctgcttgcgctgcaagccgggcaaaacctgagctgggaccgacgcaaccagttgcagcacgtgcgccccgttattcgtgaaaatggtatggacgacagcgaacgctatagctacgacgccagcggccagcgcctgcgcaaggtgcgtaccacgcaagccaaaaccattacccatacggccgatgtgcgttacctgcccggtcttgaaattcgtaccgatacggccactggtgaaaccctgcatgttgttgtggcccaggccgggcgtaataacgtgcgcgtgctgcattgggcgtctggaaagcccgacgcgcttgaaaatgatcagactcgttacaccctgaacgaccacctggggtccggcacgctggaactggatgggcaggcgcagcgtgtcagccacgaacgttattacccgttcggcggcacgtcatggtgggcggggcgtaatgcgatcgaggcgagttacaagaccgtgcgttactcgggtaaggggcgggatgcgacagggctttattactacgggctgcggtattacgcgccgtggttgcagcgctggatcaatccggacccggccggtcttgaggacgggcttaatttatacggtatgttgagaaacaacccgctcacgttcatcgacgcggtgggaggagtcgctgaaattcccaagcatattcactacatctggttgggcgctgctgaaccgctgatggagcacctggaagggatcaaaaacacttctgtgctgaatcccgactatcagttgacgctgcatctgcatctgcatctggatctgcgaaaaggtgatgaaacggaaatagcctcagcgctgcgcgggcgaagaaacgtccatatttccgacctcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcagggataccgatttcattaccaagcccaagaggattttcacgatgcgcccgacggacacaccttggaaccgtgatgaaatcgtgattaacaataactcgttcgcgtcacctgccaacaatccggtgctgagcactttggaaaaggagatagtcgaccggtacagcgtttatcgtgagacaggccttggcaaggtgctcagtagcaccgccgatgttagcgacaggatgagaatcgtttctgctgtcacggggcccaaggtgttcacagaggtattgcttaaagaggggcgtgggctaagaaagctgttttcaacaatggtcaattaccatgttaaaggtgaaaaattaaaaaacccgaagcgttatcaggcagaagcccaaaaaagaatgccactctcgaacttcataaaaatgggaggcagccactcatggcaatag

SEQ ID NO: 175 - DNA, 2781 bp, Pseudomonas Sp.
atggttgaacgctcgattgcccttcatcagcacacgccggcattacagttggtggacccgcgcggcttgcctgtgggatcaattgcgctatgccgtacgagtagcgatatcgagccgcaaatccgtaccagccatgcgtcattcgacatggcggggcgacctgtcagctgttgggacccgcgcctgtgggccgatcgggcacccgccaatctcagcgtcattcattcgctcagcggtcaggttctggccagcgacagtgtggacgcgggctggcaggtgttgttggcgggtgaggccgggcaggtgctggaggcctgggacgctcggggcgttgtgcgacgtacggggtatgacgcgctgctaaggcccatcaaggtttttgaagatgagcactgcgttgagcgcttgctttacggcggccctgattcgatcacgtataaccagtgcggtcagttgattcgtcatgacgatccggcaggcacgcggcttgacgatgcgtatggtctttcgggaaatgtgatcaggcaaacgcggcgctttctgcactctgccgatgagcctgactggcccgagtcgctgaccgggcgtgatgccttgctggagcccggtgccggcgcaaccacgtgctggcaatacaacccgctgagcgagatcacctggcaacgcgatgcgcagggcagtgttcagtgtctgggttacaccgttgcagggcagttgaaagacagtcgtttacagctcaacggtcaggccgaacaggttctggtcagtgccatccagtatgatgcgcaggggcgggtggtgtcggaaacggctggcaatggtgtgatcagcacggcgctctatgccactgaagacggtcgcctgggggaattgaataccacgcgtagtaatgggcagtcgttgcaggatttgcgttacgactatgacccggtcggtaatgtaatccgtgtcgatgatcgtgctctgccagccatctccaaaggtcagcgcatcgactcggtttcgacctatcgatacgacacgctttatcaactgatcgaagcctcgggcagggaatgggcagtcgttaatcacggcccggtgctgcctggtttccagagtcccgccgatccttcgacgctggctgattacacgcagacgtatcgctacgatgccggcggcaacctgcagcagcttacccatacaggcacgcagtcccattcgcgcacgctggtcaccgcacgttgcagcaaccgcagtctgccggtgatcaatggccacatacctgacgaagcagaaattgctgctgccttcgatgccaacggtaatctgcttgcgctgcaagccgggcaaaacctgagctgggaccgacgcaaccagttgcagcacgtgcgccccgttattcgtgaaaatggtatggacgacagcgaacgctatagctacgacgccagcggccagcgcctgcgcaaggtgcgtaccacgcaagccaaaaccattacccatacggccgatgtgcgttacctgcccggtcttgaaatccgtaccgatacggccactggtgaaaccctgcatgttgttgtggcccaggccgggcgtaataacgtgcgcgtgctgcattgggcgtctggaaagcccgacgcgcttgaaaatgatcagactcgttacaccctgaacgaccacctgggggccggcacgctggaactggatgggcaggcgcagcgtgtcagccacgaacgttattacccgttcggcggcacgtcatggtgggcggggcgcaatgcgatcgatgcgagttacaagaccgtgcgttactcgggcaaggagcgcgatgcgacagggctttattactacgggctgcggtattacgcgccgtggttgcagcgctggatcaatccggacccggccggtcttgaggacgggcttaatttatacggtatgttgagaaacaacccgctcacgttcatcgacgcggtgggaggagtcgctgaaattcccaagcatattcactacatctggttgggcgctgctgaaccgctgatggagcacctggaagggatcaaaaacacttctgtgctgaatcccgactatcagttgacgctgcatctgcatctggacctgcgaaaaggtgatgaaacggaaatagcctcagcgctgcgcgggcgaagaaacgtccatatttccgacctcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcagggataccgatttcattaccaagcccaagaggattttcacgatgcgcccgacggacacaccttggaaccgtgatgaaatcgtgattaacaataactcgttcgcgtcacctgccaacaatccggtgctgagcactttggaaaaggagatagtcgaccggtacagcgtttatcgtgagacaggccttggcaaggtgctcagtagcaccgccgatgttagcgacaggatgagaatcgtttctgctgtcacggggcccaaggtgttcacagaggtattgcttaaagaggggcgtgggctaagaaagctgttttcaacaatggtcaattaccatgttaaaggtgaaaaattaaaaaacccgaagcgttatcaggcagaagcccaaaaaagaatgccactctcgaacttcataaaaatgggaggcagccactcatggcaatag

SEQ ID NO: 176 - DNA, 2781 bp, Pseudomonas Sp.
atggttgaacgctcgattgcccttcatcagcacacgccggcattacagttggtggatccacgcgggttgcctgtggggtcaattgcgctatgccgtacgagtagcgatatcgagccgcaaatccgtaccagccatgcgtccttcgacatggcggggcgacctgtcagctgttgggacccgcgcctgtgggctgatcgggcacccgccaatctcagcgtcattcattcgctcagcggtcaggttctggccagcgacagtgttgacgcgggctggcgggttttgttggcgggtgaggccgggcaggtgctggaggcctgggatgctcggggcgttgcgcgacttacggggtatgacgcgctgctaaggcccatcgaggtttttgaagatgaacactgcgtcgagcgcttgctttacggcggccctgattcgatcgcgtataaccagtgcggtcagttgattcgtcatgatgatccggctggtacgcggcttgactatgcgtatggtctttccggaagtgtgatcagtcaaacgcggcgcttcctgcaaaacctcgacgagcctgactggcccgagtcactgaccgggcgcgatgccttgctggagcttggcgaaggggcgactactcgctggcgctacaactccgtgaacgaaactctccggcagaccgatgcgcagggcaatgttcagtgtctgggttacaccgttgcagggcagttgaaagacagtcgtttacagctcaacggtcaggccgaacaggttctggtcagtgccattcagtatgacgcgcaggggcgggtggtgtcggaaacggctggcaatggtgtgatcagcactgcgcggtatgacactgaagacggccgtttgctggcgttgaatgccacgcgtagtaatgggcagttgttgcaggatttgcgttacgactatgacccggtcggtaatgtaatccgtgtcgatgatcgtgctctgccagccatctccaaaggtcagcgtatcgactcggtttcgacctatcaatacgacacgctttatcaactgatcgaagcctcgggcagtgaatgggcagtcgttaatcacggcccggtgctgcctggtttccagagtcctgccgatccttcgacgctggctgattacacgcagacgtatcgctacgatgccggcggcaacctgcagcagcttacccatacaggcacgcagtcccattcgcgcacgctggtcaccgcacgttgcagcaaccgcagtctgccggtgatcaatggccacatacctgacgaagcagaaattgctgctgcctttgatgccaacggtaatctgctcgcactgcaagccgggcaagacctgagctgggaccgacgcaaccagttgcagtacgtgcgccccgtcgttcgcgaaaacggttcggacgacagcgaacgctatagctacgacgccagcggccagcgcctgcgcaaggtgcgtaccacgcaagccaaaaccatgacccatacggccgatgtgcgttacctgcccggtcttgaaatccgtaccgatacggccactggcgaaaccctgcacgttgttgtggcccaggccgggcgcaataacgtgcgcgtgctgcattgggcgtctggaaagcccgacgcgcttgaaaatgatcagactcgttacaccctgaacgaccatctggggtccggcacgctggaactggatggacaggcgcagcgtgtcagccacgaacgttattacccgttcggaggcacgtcatggtgggcggggcgcaatgcgattgaggcgagttacaagaccgtacgttactcaggcaaggagcgcgatgcgacaggactttattactacggtatgcggtattacgcgccgtggttacagcgctggatcaatccggaccctgccggtcttgaggacgggcttaatctatacggtatgttgagaaacaacccgctcacgttcatcgacgcgttgggaagagtcgctgaaattcccaagcatattcactacatctggttgggcgctgctgaaccgctgatggagcacctggaagggattaaaaacacttctgtgctgaatcccgactatcagttgacgctgcatctgcatctggacctgcgaaaaggtgatgaaacggaaatagcctcagcgctgcgcgggcgaagaaacgtccatatttccgacctcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcatggataccgatttcattaccaagcccaagaggattttcacgatgcgcccgacggacacaccttggaaccgggacgaaatcgtgattaacaataactcgttcgcgtcacctgccaacaatccggtgctgagcactttggaaaaggagatcgtcgaccggtacagcgtttatcgtgagacgggccttggcgaagtgctcagtagcaccgccgatgtgaacgacaggatgagaatcgtttctgctgtcacggggcccagggtgtttacagaggtattgcttaaagaagggcgcgggctaagcaagctgtttacaacgatgatcgatcaccatattaaaggtaaaccattaaaaaacccgaagcgttatcaggcagaagcccaaaaaagaatgccactctcgaacttcataaaaatgggaggcagccactcatggcaatag

SEQ ID NO: 177 - DNA, 2949 bp, Pseudomonas Sp.
attgggcaggcgttgaccaatgggcaaggcatcgacgcggagagcgcagcagtctgcccttgttgtgccactggcataagtgtcagtaggcgctacggcgccacttatttagagtgtggtacagcgcggaattttccagcgccgtcggacttgctgcaggtgccagtcatggttgaacgctcgaatgcccttcatcagcacacgccggcattacagttggtggacccgcgcggcttgcctgtggggtcaattgcgctatgccgtacgagtagcgatatcgagccgcaaatccgtaccagccatgcgtcattcgacatggcggggcgacctgtcagctgttgggacccgcgcctgtgggctgatcgggcacccgccaatctcagcgtcattcattcgctcagcggtcaggttctggccagcgatagtgtggacgcgggctggcaggtgttgttggcgggtgaggccgggcaggtgctggaggcctgggacgctcggggcgttgtgcgacgtacggggtatgacgcgctgctaaggcccatcaaggtttttgaagatgagcactgcgttgagcgcttgctttacggcggccctgattcgagcacgtataaccagtgcggtcagttgattcgtcatgacgatccggcaggcacgcggcttgacgatgcgtatggtctttcgggaaatgtgatcaggcaaacgcggcgctttctgcactctgccgatgagcctgactggcccgagtcgctgaccgggcgtgatgccttgctggagcccggtgacggcgcaaccacgtgctggcaatacaacccggtgagcgagatcacctggcaacgcgatgcgcagggcaatgttcagtgtctgggttacaccgttgcagggcagttgaaagacagtcgtttacagctcaacggtcaggccgaacaggttctggtcagtgccatccagtatgacgcgcaggggcgtgtggtgtcggaaacggctggcaatggtgtgatcagcacggcgctctatgccactgaagacggtcgcctgggggaattgaataccacgcgtagtaatgggcagtcgttgcaggatttgcgttacgactatgacccggtcggtaatgtaatccgtgtcgatgatcgtgctctgccagccatctccaaaggtcagcgcatcgactcggtttcgacctatcgatacgacacgctttatcaactgatcgaagcctcgggcagggaatgggcagtcgttaatcacggcccggtgctgcctggttttcagagtcccgccgatccttcgacgctggctgattacacgcagacgtatcgctacgatgccggcggcaacctgcagcagcttacccatacaggcacgcagtcccattcgcgcacgctggtcaccgcacgttgcagcaaccgcagtctgccggtgatcaatggccacatacctgacgaagcagaaattgctgctgccttcgatgccaccggtaatctgcttgcgctgcaagccgggcaaaacctgagatgggaccgacgcaaccagttgcagcacgtgcgccctgttattcgtgaaaatggtatggacgacagcgaacgctatagctacgacgccagcggccagcgcctgcgcaaggtgcgtaccacgcaagccaaaaccattacccatacggccgatgtgcgttacctgcccggtcttgaaatccgtaccgatacggccactggtgaaaccctgcatgttgttgtggcccaggccgggcgtaataacgtgcgcgtgctgcattgggcgtctggaaagcccgacgcgcttgaaaatgatcagactcgttacaccctgaacgaccacctggggtccggcacgctggaactggatgggcaggcgcagcgtgtcagccacgaacgttattacccgttcggcggcacgtcatggtgggcggggcgtaatgcgatcgaggcgagttacaagaccgtgcgttactcgggcaaggagcgggatgcgacagggctttattactacgggctgcggtattacgcgccgtggttgcagcgctggatcaatccggacccggccggtcttgaggacgggcttaatttatacggtatgttgagaaacaacccgctcacgttcatcgacgcggtgggaggagtcgctgaaattcccaagcatattcactacatctggttgggcgctgctgaaccgctgatggagcgcctggaagggatcaaaaacacttctgtgctgaatcccgactatcagttgacgctgcatctgcatctggatctgcgaaaaggtgatgaaacggaaatagcctcagcgctgcgcgggcgaagaaacgtccatatttccgacctcagggaagaggaatttttcagaaaattccagaaaacaccgtcatacgagatttataaggatttgtatggggatgaccctcgacactactcggcagccagtgacgtgcttcgctacagcttgatcaaccattatggcggtatttattcggacacggatgacatgttcaagcgcggtgtcagggataccgatttcattaccaagcccaagaggattttcacgatgcgcccgacggacacaccttggaaccgggatgaaatcgtgattaacaataactcgttcgcgtcacctgccaacaatccggtgctgagcactttggaaaaggagatagtcgaccggtacagcgtttatcgtgagacaggccttggcaaggtgctcagtagcaccgccgatgttagcgacaggatgagaatcgtttctgctgtcacggggcccaaggtgttcacagaggtattgcttaaagaggggcgtgggctaagaaagctgttttcaacaatggtcgattaccatgttaaaggtgaaaaattaaaaaacccgaagcgttatcaggcagaagcccaaaaaagaatgccactctcgaacttcataaaaatgggaggcagccactcatggcaatag

SEQ ID NO: 178 - DNA, 2790 bp, Pseudomonas Sp.
atggttgaacgctcgattgcccttcatcagcacacgccggcattacagttggtggacccgcgtggcttgcctgtggcgtcgattttgctgcatcgctcaagcatcgaccacgagccggaactccgtaccagccaggcgtcattcgaccttgccagtcgacctgtcagccattgggatccgcgcctgtgggctgatcgggcacctgccaatctcagcgtcattcattcgctcggcggtcgggttctggccagcgacagtgtggacgctggctggcgagtgttgctggcgggggaggccgggcaggtagtggaagcctgggacgctcggggcgttgtgcgacgtactcagtacgatgcgctgctaaggcccaccgaagtttttgaagatgagcactgcgttgagcgcttgctttatggcggccctgactcgaccgcatataaccagtgcggtcagttgattcgtcatgatgatccggcaggtacgcggcttgacgatgcgtatggtctttcgggaagtgttattcgtcaaacgcggcgctttctgcactctgccaatgagcctgactggcccgcgtcgctggccgggcgtgatgccttgctggaacccggcgacggcgcaaccacctgctggcactacaacccgttgaacgaaacaattcggcaaatcgatgcgcagggcaatgttcagttgctggattacaccgttgcggggcagttgaaaaacagtcgtttgcaactgaactgtcaggctgaacaggttttggtcagtgccattcaatacgacgcgcagcagcgggtggtgtcggaaacggctggtaatggtgtgatcagcacggcgctctatgccactgaagacggtcgtctactggagttgaatgccaggcatggcaatgggccgatgttgcaggacttgctctacggctacgatcccgttggcaatgtcatccgtatcgaggaccgcgctcagtcaacggcttataaccgcaatcagcgcatcgaccctgtttcggcctatggctacgacacgctgtaccaactgatcgaagccacaggtcgggaatcagcggtcgtcaatcacggtccggtgtttccgggttttcaaagccctgccgaccctgcgcaactggccaattacacccagacctaccgctacgacgcgggtggcaacctgcaacagcttacccatacaggcgcgcagtcccattcgcgaacgctggtgactgcgcgttacagcaaccgcagtctgccggtgatcaatgaccatatacccggtgaagctgaaattgctgcagccttcgacgccaatggcaatttgctcgccctgcaagccgggcaagatctgagttgggatcgacgcaaccagctgcagcaagtgcgtccagtggttcgtgaatccggcaatgatgacagcgaacgctacagctacgacgccagcggccagcgcctgcgcaaggtgcgtaccacgcaggccaaaaccattacccatacggccgacgtgcgctacttgccagggctggaagtgcgcaccgatagcgtcactggcgaaaccctgcacgttgttgtggcccaggccggtcgcaataacgtgcgcgtgctgcattgggcgtctggaaagcccgacgtgcttgaaaatgatcagactcgctacaccctgaacgaccacctggggtccggcacgctggaactggacgggcaggcgcagcgtgtcagtcaggaaagttattacccgttcggcggcacgtcatggtgggcggggcgcagtgcgatcgaggcgagttacaagaccgtgcgttactcgggcaaggaacgcgatgcgacggggctttattattacgggatgcggtattacgcgccgtggttgcagcgctggatcaatccggacccggctgggcttgaagacgggcttaatctatacggtatgttgagaaacaatccgctcaccttcatcgacgctgcgggagaagtcgctgaaatccccaagcatattcattacatctggttgggcgctgcggaaccactgatgaagcacctgggagggattgaaaacacttctgtgctgaaccctgactatcaattgacgctgcatctgcatctgcatctggacctgcgaaagggtgatgaaacggaaatagttgcagcgctgcgcgggcgaaggaacgtccatatttccgatctcagggaagaagaatttttcagaaaattccagaaaaccccgtcgtacgagatttataaggatttgtatggggatgaccctcgacactactctgcagccagtgacgtgcttcgctacagcttgatcaaccattatggcggtatttattcggacacggacgacatgttcaagcgcggtgtcagggataccgatttcattcccaagcccaagaggattttcacgatgcgcccgacggacacaccttggaaccgggatgaaatcgtgattaacaataattcgttcgcgtcacctgccaacaatccggtgctgagcaccttggaaaaggagatcgtcgaccggtacagcgtttatcgtgagactggccttggcgcagtgctcagtagcaccgccgatgtgaatgacaggatgagaatcgtttctgctgtcacggggcccagggtgttcacagaggtattgcttaaagaggggcgcgggctgagcaagctgttttcaacgatgatcgatcaccatattaaaggtaaaccattaaaaaacccgaagcgttatcaggcagaagcccaaaaaagaatgccactctcgaacttcataaacatgggaggcagccactcatggaaatag

SEQ ID NO: 179 - DNA, 2784 bp, Pseudomonas Sp.
atggttgaacgctcgattgcccttcatcagcacacgccggcattacagttggtggacccgcgtggcttgcctgtggcgtcgattttgctgcatcgctcaagcatcgaccacgagccggaactccgtaccagccaggcgtcattcgaccttgccagtcgacctgtcagccattgggatccgcgcctgtgggctgatcgggcacctgccaatctcagcgtcattcattcgctcggcggtcgggttctggccagcgacagtgtggacgctggctggcgagtgttgctggcgggggaggccgggcaggtagtggaagcctgggacgctcggggcgttgtgcgacgtactcagtacgatgcgctgctaaggcccaccgaagtttttgaagatgagcactgcgttgagcgcttgctttatggcggccctgactcgaccgcatataaccagtgcggtcagttgattcgtcatgatgatccggcaggcacgcggcttgatgatgcgtacggtctttcgggaagtgttattcgtcaaacgcggcgctttctgcactctgccaatgagcctgactggcccgcgtcgatggccgggcgtgatgtcttgctggaacccggcgacggcgcaaccacctgctggcactacaacccgttgaacgaaacaattcggcaaatcgatgcgcagggcaatgttcagttgctggattacaccgttgcggggcagttgaaaaacagtcgtttgcaactgaactgtcaggctgaacaggttttggtcagtgccattcaatacgacgcgcagcagcgggtggtgtcggaaacggctggcaatggtgtgatcagcacggcgctctatgccactgaagacggtcgtctgctggcgttgagtgccagacgggccgatgggctgatgctgcaggacttgctgtacgactacgacccggtcggtaatgtcatccgtatcgaggaccgcgctcagtcaacggcttataaccgcaatcagcgcattgatcctgtttcggcctatggctacgacacgctgtaccaactgatcgaagccacaggtcgggaatcagcggtcgtcaatcacggtccggtgtttccgggttttcaaagccctgccgaccctgcgcaactggccaattacacccagacctaccgctacgacgcgggtggcaacctgcaacagcttacccatacaggcgcgcagtcccattcgcgaacgctggtgactgcgcgttacagcaaccgcagtctgccggtgatcaatgaccatatacccgatgaagcagaaatcgctgcagccttcgacgccaatggcaatttgctcgccctgcaagccgggcaaaacctgagctgggaccggcgcaaccagttgcagcaagtgcgtccagtggttcgcgatgacgctgcggacgacagcgaacgctatatatacgacgccagcggccagcgcctgcgcaaggtgcgtaccacgcaagccaaaaccattacccatacggccgatgtgcgttacctgcccggtcttgaaatccgtaccgatacggccactggcgaaaccctgcacgttgttgtggcccaggccgggcgcaataacgtgcgcgtgctgcattgggcgtctggaaagcccgacgcgcttgaaaatgatcagactcgctacacagtgaacgaccacctggggtccggcacgcttgaactggacgcgcaggggcaactgatcagtcaggaaagttactacccgtttggcggaacatcatggtgggcaggtcgaaatgccatcgaagcgaactacaagaccgtgcgttactcgggcaaggaacgcgatgcgacggggctttattattacgggatgcggtattacgcgccgtggttacagcgctggatcaatccggacccggctgggcttgaagacgggcttaatctatacggtatgttgagaaacaatccgctcaccttcatcgacgctgcgggagaagtcgctgaaatccccaagcatattcattacatctggttgggcgctgcggaaccactgatgaagcacctgggagggattgaaaacacttctgtgctgaaccctgactatcaattgacgctgcatctgcatctggacctgcgaaagggtgatgaaacggaaatagttgcagcgctgcgcgggcgaaggaacgtccatatttccgatctcagggaagaagaatttttcagaaaattccagaaaaccccgtcgtacgagatttataaggatttgtatggggatgaccctcgacactactctgcagccagtgacgtgcttcgctacagcttgatcaaccattatggcggtatttattcggacacggacgacatgttcaagcgcggtgtcagggataccgatttcattcccaagcccaagaggattttcacgatgcgcccgacggacacaccttggaaccgggatgaaatcgtgattaacaataattcgttcgcgtcacctgccaacaatccggtgctgagcaccttggaaaaggagatcgtcgaccggtacagcgtttatcgtgagactggccttggcgcagtgctcagtagcaccgccgatgtgaatgacaggatgagaatcgtttctgctgtcacggggcccagggtgttcacagaggtattgcttaaagaggggcgcgggctgagcaagctgttttcaacgatgatcgatcaccatattaaaggtaaaccattaaaaaacccgaagcgttatcaggcagaagcccaaaaaagaatgccactctcgaacttcataaacatgggaggcagccactcatggaaatag

SEQ ID NO: 180 - DNA, 2784 bp, Pseudomonas Sp.
atggttgaacgttcgattgcccttcatcagcacacgccggcattacagttggtggatccgcgcgggttgcctgtggtgtcaattgcgctatgccgcgcgagtagcgatatcgaaccgcaaatccttggtagccatgcgtcgttcgacatggcggggcgacctgtcagccattgggatccgcgcctgtgggctgatcgggcacctgccaatctcagcgtcattcattcgctcagcggtcgggttctggccagcgacagtgtggatgcgggctggcgggtgttgctggcgggggaggccggacaggtgctggaggcctgggatggccggggcattgtgcgacgtactcagtacgatgcgttgctcaggcccacggaggtttttgaagatgaacactgcgttgagcgcctgctttatggcggccctgatgcgaccgcgtataaccagtgcggtcagttgattcgtcatgacgatccggcaggtacgctgcttgacgacgcgtacggtctttcgggaagtgtgatccgtcaaacacgacggtttctgcacgcagtcgatgagcctgactggcccgagtcgctgaccgggcgcgatgccttgctggagcccggcgacggtgcgaccacccactggcgctataacccgctgaacgagaccacccggcagaccgatgcgcagggcaatgttcagtcgttggattacaccattgcaggtcagttgaaagacagtcgtttacagctcaacggtcaggccgaacaggttctggtcagtgccattcagtacgacgcgcaggggcgggtggtgtcggaaacggctggcaatggggtgatcagcactgcgctttatgccactgaagacggtcgtctgctggagctgaatgccaggcgggccaatgggccgatgttgcaagacttgctgtacgactacgacccggtcggtaacgtaattcgtatcgaggatcgcgctcagccaacggtctatagcggcaatcagcgtatcgaccctgtttcgacctatcaatacgacacgctttaccaactgatcgaagccacgggcagggaatcatcagttgtcaatcacggccccgtgcttcccggtttccagagccctgcggatcccacgcagctggccaactacacgcagacctaccgctacgacgcaggtggcaacctgcaacagcttacccattcaggcgcgcagtcccattcgcgaacactggtgactgcgcgttacagcaaccgtagtctgccggtgatcaataaccataagcctgaagaagcagaaatcgctgctgccttcgacgccaatggcaatttactcgccctgcaagccgggcaggacctgagttgggatcgccgcaatcagttgcagcaagtgcggccagtgattcgtgaatccggcaatgacgacagtgaacgatacagttacgacgccagcggccagcgcctgcgcaaggtgcgcaccacccaggccaaagccgtcacccacatcgccgacgtgcgctatctgccaggacttgaaatacgcactgatagcgccaccgatgaagccctgcacgtcgtggttgctcaaggcggacgcaacagtgcacgagtgctgcactggcagaccggcaagcccgatgcaattaaaaatgaccagatccgctacaccctgagtgatcatctggggtccggcccgcttgaactggacgcgcaggggcgactgatcagtcaggaaagttactacccgtttggcggaacatcatggtggacaggtcgcaatatcatcgaggcgagttataagaccgtgcgttactcgggtaaggagcgtgatgcgacagggctttattattacgggctgcggtattacgcgccgtggttacagcggtggatcaatccggaccctgccggtatcgaggacggacttaatctatacggtatgttgaggaacaacccgctcacgttcattgacgctgggggaggagtcgctgaaatccccaagcatattcactacatctggttgggcgctcccgaaccattgatgaaacaccttaaagggattgaaaacacttctgtgctgaaccccgactatcaaatgacgctgcatctgcatatggacctgcgaaagggtgatgaaacggaaatagtttcggcgctgcgcgggcgaaggaacgttcatatttcaaatctcagggaagaagaatttttcaagaagtttcagaaaaccccgtcatacgagatttataaggatttgtatggggatgatcctcgacactactcggcagccagtgacgtgctgcgatacagcctgatcaaccattatggcggtatttattcagacaccgacgactcgttcactcgcggtatcagggattccgatttcataaccaaacacaaccgggtcttcacgttgtatcccacggatacgccttggaacaggagtgaattcgtgcttaacaacagctcgttcgcttcacctgctaaaaatccggtgctcagcagtttggaaaaggaggtcgtcagccggtacagcgtctatcgagagacgggccttggaaaagtgctcagtagcaccgccgatgtaaacgacaggatgagaattgtttcagccgtgacggggcccagagtgttcacggacgtgttgctcagggaagggcgtgggttaaaaaagctgttttcaacaatgatcaatcaccatgttaagggtgaaaaattaaaaaatccggaacgtcatcatgcagaaactgagaagcgaatgccactctcgcgcttcgtgaaaatgggaagcagccactcttggcgatag

SEQ ID NO: 181 - DNA, 2643 bp, Pseudomonas Sp.
atggttgaacgttcgattgctcttcatcaacacacgccggcattacagttggtggatccgcgcgggttgcctgtggtgtcaattgcgctatgccgcgcgagtagcgatatcgaaccgcaaatccttggtagccatgcgtcattcgacatggcggggcgacctgtcagtcgttgggatccgcgtctgtgggctgatcgggcacccgccagtctcagcgtcattcattcgctcagcggtcaagttctggccagtgacagtgtggatgctggctggcgggtgttgctggcgggggaggccggacaggtgctggaggcctgggatggccggggcattgtgcgacgtactcagtacgatgcgttgctcaggcccacggaggtttttgaagatgaacactgcgttgagcgcctgctttatggcggccctgatgcgaccgcgtataaccagtgcggtcagttgattcgtcatgacgatccggcaggtacgctgcttgacgacgcgtacggtctttcgggaagtgtgatccgtcaaacacgacggtttctgcacgcagtcgatgagcctgactggcccgagtcgctgaccgggcgcgatgccttgctggagccccacgaaggtgccaccacccactggcgctacaacccgttgaacgagaccacccggcagaccgatgcgcagggaaatgttcagtcgctggattacaccgttgcgggtcagttgagaggcactcgtttgctgctaaacggtctggccgaaaatgttctggtgagtgccattgaatatgacgcgcaagagcgggtggtgtcggaaacggctggcaatggggtggtcagcacggcgctttatgccactgaagacggtcgtctgctggagttgaatgccaggcgggccgatgggccgatgttgcaagacttgctgtacgactacgacccggtcggtaacgtaattcgtatcgaggatcgcgctcagccaacggtctatagcggcaatcagcgtatcgctcctgtttcgacctatcaatacgacacgctttaccaactgatcgaagccacgggcagggaatcatcagttgtcaatcacggcccggtgcttcccggtttccagagccctgcggatcccacgcagctggccaactacacgcagacctatcgttacgacgcaggtggcaacctgcaacagcttacccatacaggcgcgcagtcccattcgcgaacactggtgactgcgcgttacagcaaccgcagtctgccggtgatcaatgaccatatacctgacgaagcagaaatcgctgctgccttcgatgccaatggcaatttgcttgccctgcaagccgggcaggacctgagttgggatcgacgcaaccagttgcagcaagtgcggccagtgattcgtgaatccggcaatgacgacagtgaacgatacagttacgacgccagcggccagcgcctgcgcaaggtgcgcaccacacaggccaaagccgtcacccacatcgccgacgtgcgctatctgccaggacttgaaatacgcactgatagcgccaccggtgaaaccctgcacgtcgtgattgctcaaggcggacgcaataatgtgcgcgtgttgcattgggcgtctggaaagcccgacgcgcttgaaaatgaccagactcgctacaccctgaatgaccatctgggctgcggcacgcttgaactggatgcgcaggggcaactgatcagccaggaaagttactacccgtttggcggaacatcatggtgggcggggcgcaatgccatcgaagcgaactacaagacagtgcattactcgggcaaagagcgcgatgcgacggggctttattattacgggctgcggtactacgcgccttggttacagcgctggatcaatccggacccggccggtatcgaggacggacttaatctgtacggtacgttaaggaacaacccgctcacgttcattgacgctgggggaggagtcgctgacatccccaagcatattcactacatctggttgggcgctcccgaaccattgatgaaacaccttaaagggattgaaaacacttctgtgctgaaccccgactatcaaatgacgctgcatctgcatatggacctgcgaaagggtgatgaaacggaaatagtttcggcgctgcgcgggcgaaggaacgttcatatttcaaatctcagggaagaagaatttttcaagaagtttcagaaaaccccgtcatacgagatttataaggatttgtatggggatgatcctcgacactactcggcagccagtgacgtgctgcgatacagcctgatcaaccattatggcggtatttattcagacaccgacgactcgttcactcgcggtatcagggattccgatttcataaccaaacacaaccgggtcttcacgttgtatcccacggatacgccttggaacaggagtgaattcgtgcttaacaacagctcgttcgcttcacctgctaaaaatccggtgctcagcagtttggaaaaggaggtcgtcagccggtacagcgtctatcgagagacgggccttggaaaagtgctcagtagcaccgccgatgtaaacgacaggatgagaattgtttcagccgtgacggggccagagtgttcacggacgtgttgctcagggaagggcgtgggttaa

SEQ ID NO: 182 - DNA, 2232 bp, Pseudomonas Sp.
atggttaaacgctcgattgcccttcatcagcacacgccggcattacagttggtggatccacgcgggttgcctgtggggtcaattgcgctatgccgtacgagtagcgatatcgagccgcaaatccgtaccagccatgcgtccttcgacatggcggggcgacctgtcagctgttgggacccgcgcctgtgggctgatcgggcaaccgccaatctcagcgtcattcattcgctcagcggtcaggttctggccagcgacagcgtggacgcgggctggcgggttttgttggcgggtgaggccgggcaggttctgaaggcctgggatgctcggggcattgtgcgacgtacggggtatgacgcgctgctaaggcccatcgaggtttttgaagatggacactgcgtcgagcgtctgctttatggcggccctgattcgactgatcacaaccagtgtggtcagttgattcgtcatgacgatccggcaggtacgcggcttgacgatgagttcggtctttccggaagtgtgatcagtcaaacgcggcgcttcctgcaaaacctcgacgagcctgactggcccgagtcactgaccgggcgcgatgccttgctggagcttggcgaaggggcgactactcgctggcgctacaactccgtgaacgaaactctccggcagaccgatgcgcagggcaatgttcagtgtctgggttacaccgttgcagggcagctgaaagacagtcgtttacagctcaacggtcaagccgaacaggttctggtcagtgccattcaatacgatgcacaggagcgggtggtgtcggaaacggcgggcaacggagtgatgagcacggcgcggtatgacactgaagacggccgtttgctggcgttgaatgccacgcgtagtaatgggcagttgttgcaggatttgcgttacgactatgacccggtcggtaatgtaatccgtgtcgatgattttgctctgccagccatctccaaaggtcagcgcatcgactcggtttcgacctatcgatacgacacgctttatcaactgatcgaagcctcgggcagggaatgggcagtcgttaatcacggcccggtgctgcctggtttccagagtcctgccgatccttcgacgctggctgattacacgcagacgtatcgctacgatgccggcggcaacttgcagcagcttacccatacaggcacgcagtcccattcgcgcacgctggtcaccgcgcattacagcaaccgcagtctgccggtgatcaatggccacatacctgacgaagcagaaattgctgctgcctttgatgccaacggtaatctgctcgcactgcaagccgggcaagacctgagctgggaccgacgcaaccagttgcagcacgtgcgccccgttattcgtgacaacggcatggacgacagcgaacgctacagctacgacgccagcggccagcgcctgcgcaaggtgcgtaccacgcaagccaaaaccatgacccatacggccgatgtgcgttacctgcccggtcttgaaatccgtaccgatacggccactggcgaaaccctgcacgttgttgtagcccaggccgggcgcaataacgtgcgcgtgctgcattgggcgtctggcaagcccgacgcgcttgaaaatgatcagactcgctacaccctgaacgaccacctggggtccggcacgctggaactggatgggcaggcgcagcgtatcagccaggaaagttattacccgttcggcggcacgtcatggtgggcggggcgcaatgcgattgaggcgagttacaagaccgtgcgttactcaggcaaggagcgcgatgcgacagggctttattattacggtttgcggtattacgcgccgtggttacagcgctggatcaatccggacccggccggtcttgaggacgggcttaatctatacggtatgttgagaaacaacccgctcacgttcatcgacgcggtgggaggagtcgctgaaattcccaagcatattcactacatctggttgggcgctgctgaaccgctgatggagcacctggaagggattaaaaacacttctgtgctgaatcccgactatcagttgacgctgcatctgcatctggacctgcgaaaaggtgatgaaacggaaatagcctcagcgctgcgcgggcgaaaaaacgtccatatttccgacctcagggaagaggaatttttcagaaaattccagaaaacaccgtcatacgagatttataaggatttataa

SEQ ID NO: 183 - DNA, 2772 bp, custom Sp.
atggttgagacgttacttgccttacacgcgcgtactccctctctgcatgcgatggacccgcgtcaacggctcatccactccattgctttctgtcgtctgacacccgacgacgagccggaagtgcggatcagtcacacggtttttgatgtcgcaggccgaccgtcaatgagttgggatgcccgtctgtgggccgaccgggcacccgccaatgtgacgaatattcataccctcagcgggcaggttgttgcctccgagagtgtggatgccggctggcgtgtgtcgttggcaggtgacgccgggcaggaggtgagcgcctgggatggtcggggtgttgcgcgacgcactcgatacgacgcacagctcagacccactcatgtttttgaggaccaacactgtgtcgaacgtctgctttatggcggtgctgagtcggcgtctcgtaatcagtgcggtcaattgattcgtcatgacgatccggcagggacgcagcttgaggatgaatacagtctttcggggcatgtgctcagtcaaacgcggcgcttcctgaaaaatcacgacaggcctaactggcccgagtcgttggccgcacgtgatgccttgctggaaatcggtgccggtgcaaccacttgctggcactgcaacccgttgagcgaaaccctccggcaaactgatgctcagggtaatgtccagtctttggactacacccttgcgggtcaattgaaaagcagccgtttgcggctgcacggtcaggctgaaaaggtcttggtcagccagctccagtacgacgcgcagcagcgggtggtgtcggagacggctggtaatggagtgatcagcacagcgaggtacggcactgaagacggtcgtctgctggaactgaaagccaggcgtggcaatggcgaggttttacaggatttgctctacgactacgatccggtcggcaatgtgatccgtatcgaggaccgtgctcagccaaccgcctacaacggcattcagcgcatcgaccctgtttcgacgtatcgctacgacacgctttatcagctggtcgaagcctcgggcagggaatcagcggtcgttaatcaaggcccggtgtctgccggttttcaaaggcttgccgacccagcgaaactgtcccgttacacgcagatctaccgctatgacgcgggcggtaatcttcagcaactgacccatcacggcgcgcagccccgctcaagcaaacgggtcaccgctcgctacagcaatcgcagcctgccggtgatcaatgaccggatacccgacgaaacagagatcgccgccgcatttgactccaacggtaatctgcttgccttgcaagccggacaagacgtgaactgggacccacgcaaccagttgcagaaagtgcgccccgtgattcgcgaaaacgcgatggacgacagcgagtgctatgtctacgacgccagcggccagcgcctgcgcaaggtgcgcatgacgcaggccaaaaccgtcgtccacagcgctgaagtgcgttatctgccaggcctcgaagtgcgcactgacagcgcgacgggtgaaaccctgcacgtcgtggttgcccaaggcggacgcaataacgtgcgcgtgctgcactggcaggccggcaagcctgacacgcttgaaaatgactcgattcgctacacgctgaatgaccatctgggctccagcgccctagagctggacgcgcaggcacaactcatcagtcaggaaagttactacccgttcggtggtacgtcatggtgggcgggccgcagtgccatcgaagcgaactacaagaccgtgcgctactcgggcaaggagcgtgacgcgacggggctttattactacgggctacggtattacgcgccgtggttgcagcggtggatcaatccggacccggcgggggaagggttgaacctgtacggaatgttgagcaataacccgctcacgttcatcgacgctcaggggggagtcgctgaaattcccgagcatattcactacatctggttgggcaaggccgcgccactgatgaaacatttgagcgggattagacgcaacgctgtggtgaatcctgattatcaattgacgctgcatttacacctgcgctcgggtaacgaatcacgcattgcgtcagcgttgcacgaggaaaaaaacgtcaagatttcggatctcagagaagaagcgttttttaagagattcaaagaaacagcgtcctacaatatttatacggatttatatggggatgaccctcgacactatgcggcggccagtgatgtgcttcgatacagcctgatcaactattatggtggtatttattcggacaccgatgacacgttcatgcgcgggttcaggaagactgatttcaaaaccaaacctaaaagggttttcacgctggatgctatggctacaccttggaacagcagtgaaatcgtgattcccaatagcacgtttgcgtcgcatgctaaaaatccggtgctgagcgccttggaaaatgaggtcgtcagtcggtacagtgattatcgtgagacggggctcggtcatattttaagcagcaccgctgatgttggcgacaggatgaaaattgtctcggacgtgacgggccccaaggtattcacagaggtgttgctgaaagagggacgtggtttgagaaagcttttttcattaatggtcaaccacaacatccatcatgaaaaattaagcagtccgaaaagttatcagaaagaaattaaaaaaagaatgcccttttcatacatcgtagaaataggaaacagccattcctggcgatag

SEQ ID NO: 184 - DNA, 1413 bp, custom Sp.
atgatgctgcgtccgtctgttctgaaccgtcgtcgtttcctgggtctggcggcgctgggtggtaccggtctggcgctgccgaccacctctctggcgcagcacctggaagcggcgccgaccgcgaccttcgacggtgactggtggtggggtgcgttccgtgcgctgaccctgaaagcgctggcggcggttccggaagttggtggtatcctgtctttcttcggtggtctgttcatcccgacccacctgttcgactctgaagacgcgcagtggcgtcagtacatcgacgcggttaaccgtatcgttgaccagaaactggacgacgcgatctacctgcaggttcaggcgtctctggttggtttcacccgtaccacccgtctgttcctgtctgcgctgcagaccggtgacgcgcagcacatccgttctgttatcgacgcgatgaacgtttctttcaccgcgtctatccagggtttcatgctgaaaggtcacgaagcgcgtctgctgccgctgttcgttccggttgcgaacctgcacctgggtctgctgcgtcaggcggttcagcagggtcaccgtcgtggtttcccggcggcggttatcctggactaccaggcgcagctgcagtctggtatcgcggactacggtgcgtactacgacgcggtttacgaacagcagctgcaggcgaccgcgaaagcgcacccgcacgacggtggtcgtcaccgtaacgaaccgctggcgtctgtttacaccctgcgttctcagctgcagatctctctgggtgacatgcgtgactgctgggcgtacttcgacaccgcgcgttacccggacgcgatccaggttcgtctggaccgtgaactgttctctatgctgatcggttcttactacgacgaccgtgttccggaaccggcgaccgttaccctgccggttccgccgaccggtccgatccgttctatcaccctgcagggttacgttttcgttgacggtctgaccctgtcttacgcggcgggtcagggtccggaccgtgttgacgcggttcacgttggtggtgcgggtggtgcgttcttctctatcgacgacatcgttgaacgtggtcacgttcgtgcggttctggttcagcacggttacgcggttgaccgtctgggtctggaatacggtgacggtaccctgtctggtaccgttggtaacaccggtaaccaggacccggcggcgcgtctggcgttcccgggtcaccacctgtcttctgttatcggtttcggtaccgcggcgggttacggtggtgttctgtctggttgcatgttcggtttccagctggacgaaccgtctgcgccggttgcgttcgaccgtcgtgttcaggaccgtctgcagcgtgtttggccgtctggtctgcaggcggcgctgcgtcgttctgcgcagggttaa

SEQ ID NO: 185 - DNA, 1413 bp, custom Sp.
atgatgctgcgtccgtctgttctgaaccgtcgtcgtttcctgggtctggcggcgctgggtggtaccggtctggcgctgccgaccacctctctggcgcagcacctggaagcggcgccgaccgcgaccttcgacggtgactggtggtggggtgcgttccgtgcgctgaccctgaaagcgctggcggcggttccggaagttggtggtatcctgtctttcttcggtggtctgttcatcccgacccacctgttcgactctgaagacgcgcagtggcgtcagtacatcgacgcggttaaccgtatcgttgaccagaaactggacgacgcgatctacctgcaggttcaggcgtctctggttggtttcacccgtaccacccgtctgttcctgtctgcgctgcagaccggtgacgcgcagcacatccgttctgttatcgacgcgatgaacgtttctttcaccgcgtctatccagggtttcatgctgaaaggtcacgaagcgcgtctgctgccgctgttcgttccggttgcgaacctgcacctgggtctgctgcgtcaggcggttcagcagggtcaccgtcgtggtttcccggcggcggttatcctggactaccaggcgcagctgcagtctggtatcgcggactacggtgcgtactacgacgcggttgttgaacagcagctgcaggcgaccgcgaaagcgcacccgcacgacggtggtcgtcaccgtaacgaaccgctggcgtctgtttacaccctgcgttctcagctgcagatctctctgggtgacatgcgtgactgctgggcgtacttcgacaccgcgcgttacccggacgcgatccaggttcgtctggaccgtgaactgttctctatgctgatcggttcttactacgacgaccgtgttccggaaccggcgaccgttaccctgccggttccgccgaccaaagcgatcaccaaaatcgaactgtggggttacgttttcgttgacggtctgaccctgtcttacgcggcgggtcagggtccggaccgtgttgacgcggttcacgttggtggtgcgggtggtgcgttcttctctatcgacgacatcgttgaacgtggtcacgttcgtgcggttctggttcagcacggttacgcggttgaccgtctgggtctggaatacggtgacggtaccctgtctggtaccgttggtaacaccggtaaccaggacccggcggcgcgtctggcgttcccgggtcaccacctgtcttctgttatcggtttcggtaccgcggcgggttacggtggtgttctgtctggttgcatgttcggtttccagctggacgaaccgtctgcgccggttgcgttcgaccgtcgtgttcaggaccgtctgcagcgtgtttggccgtctggtctgcaggcggcgctgcgtcgttctgcgcagggttaa

SEQ ID NO: 186 - DNA, 1413 bp, custom Sp.
atgatgctgcgtccgtctgttctgaaccgtcgtcgtttcctgggtctggcggcgctgggtggtaccggtctggcgctgccgaccacctctctggcgcagcacctggaagcggcgccgaccgcgaccttcgacggtgactggtggtggggtgcgttccgtgcgctgaccctgaaagcgctggcggcggttccggaagttggtggtatcctgtctttcttcggtggtctgttcatcccgacccacctgttcgactctgaagacgcgcagtggcgtcagtacatcgacgcggttaaccgtatcgttgaccagaaactggacgacgcgatctacctgcaggttcaggcgtctctggttggtttcacccgtaccacccgtctgttcctgtctgcgctgcagaccggtgacgcgcagcacatccgttctgttatcgacgcgatgaacgtttctttcaccgcgtctatccagggtttcatgctgaaaggtcacgaagcgcgtctgctgccgctgttcgttccggttgcgaacctgcacctgggtctgctgcgtcaggcggttcagcagggtcaccgtcgtggtttcccggcggcggttatcctggactaccaggcgcagctgcagtctggtatcgcggactacggtgcgtactacgacgcggtttacgaacagggtctgcaggcgaccgcgaaagcgcacccgcacgacggtggtcgtcaccgtaacgaaccgctggcgtctgtttacaccctgcgttctgaaatgaccatctctctgggtgacatgcgtgactgctgggcgtacttcgacaccgcgcgttacccggacgcgatccaggtttacctggaccgtgaactgttctctatgctgatcggttcttactacgacgaccgtgttccggaaccggcgaccgttaccctgccgtctccgccgaccaaagcgatcaccaaaatcgaactgtggggttacgttttcgttgacggtctgaccctgtcttacgcggcgggtcagggtccggaccgtgttgacgcggttcacgttggtggtgcgggtggtgcgttcttctctatcgacgacatcgttgaacgtggtcacgttcgtgcggttctggttcagcacggttacgcggttgaccgtctgtggctggaatacggtgacggtaccctgtctggtaccgttggtaacaccggtaaccaggacccggcggcgcgtctggcgttcccgggtcaccacctgtcttctgttatcggtttcggtaccgcggcgggttacggtggtgttctgtctggttgcatgttcggtttccagctggacgaaccgtctgcgccggttgcgttcgaccgtcgtgttcaggaccgtctgcagcgtgtttggccgtctggtctgcaggcggcgctgcgtcgttctgcgcagggttaa

SEQ ID NO: 187 - DNA, 1260 bp, Photorhabdus Sp.
atgcagacagagaatgttttagacataagaaccattgtggctaatgaatatgctataaaaacgagtgcattagagtgggatgttactgatattgtaaaaaatgcaatcataggaggcatatcttttatacctacggttggtcctgctatatcttttttagtcggtttattttggcctcaatcaaaagaaaatatatgggaagggattgtcaaacaaattgagaggatgatagaggaatctgcattaaagacgattaaaggtatccttgctggtgatattgcctatatacaagagcgaatggcaactgttgctgatcttcttgagaaacatccaggatcggcagaagcgcggagtgcttttaataacctggcagaaaatatagatggttatcacaaaaaatttaataatttctcggatgatgtaaattatcagatattacccatgttttctactacagttatgatgcagataacatattgggttgctggtttagagagaaaagatgaaatagggcttagtgatattgatattgaaaaagtccgagggttaattaaaaagacagtagaacaggctaataattatattaataatatatatggtagagaacttaatgatgctcttaataattcgacggctgacactgttgcaaataatgttatgtctgttcatggtcattgtcgtttacatggaattgaatatatcagtatttgggatagattaagtgaaactgagtctgtaaataatagaatctatgttgatgttttaagttattctactttctttgaccgtcaaacagcaaaggccagaattcaggcattgacgccagagaaagatatggctccacctctcaaaccggctcttaatggaggaaagagaagaaagataaattcgttaatgggacatattgtacgtattggaggggcgccaagggtaggagggctgacagttatatttgatgatggtagtcgccatcaattagggacaatatctggtgagacggcatctatttctctggatggtaatcgaattactagtttggaagtatggggcaatggtgctgttgataaagctgtctttactttgagtgatggtcgttcgttgtcatttggcgcacctggaacatccagatataggaagttttatgttggtgaaagtcactacatttcagggatctatttgtccagtgattacagcccgttagcaggtcaggcagcaaatatagctgtatcttatcagctgataaatgatgatgaaaaataa

SEQ ID NO: 188 - DNA, 1260 bp, Photorhabdus Sp.
atgcagacagaaaatgttttagacataagaaccattgtagctaatgaatatgcggtaaaaacgagtgcattagagtgggatgttactgacattgtaaaaaatgcaatcatagggggaatctcttttataccctcagttggccctgctatatcttttttagtcggtttattctggcctcaatcgaaagaaaatatatgggaagggattgtcaaacaaattgaaaggatgatagaggagtctgcgttaaagacgattaaaggtatccttgcaggtgatattgcatatatacaagagcggatggcaaccgttgctgatcttcttgataagcacccaggatcagaagaagcgaggagtgcttttaataacctggcagaaaatatagacggttatcacaaaaaatttaataatttttccgatgatgttaactatcagatattgcccatgttttctactacggttatgatgcagataacatattgggttgctggtttagagagaaaagatgaaattgggcttagtaatatcgatattgaaaaagtccgaggattaattaaaaagacggtagaacaggctaatagctatattaataatatatatgatagagagttaaatgatgctcttaataactcgacggctgatactgttgcaaataatgtgatgtctgttcatggtcactgtcgtttacatggaattgaatatatcagtatttgggatagattaagtgaagctgagtctgtaaataatagaatctatgttgatgttttaagttattctactttctttgaccgtcaaacagcaaaagccagaattcaggcattgactccagagaaagatatgactccacctctcaaaccggctcttaatggaggaaaaaggagaaggatagattcgttaacgggacatattgtgcgtattggcggggcagcgagggtcggaggtctgacagttgtatttgatgatggtagtcgccatcaattaggtacaatatctggtgagacgtcatctatttctctgaatggtagtcgaattaccagtttggaagtatggggcaatggtgctgttgatcaagcggtctttactttgagagatggtcgttcattgtcattaggttctcctggaacatctcggtataggaaattttatgtcggtgaaagccactatattgcagggatatatttgtccagtgattacagcccattagccggtcaggcagcaaatattgctgtatcttatcaactgataaatgatgatgaaaagtaa

SEQ ID NO: 189 - DNA, 1260 bp, Photorhabdus Sp.
atgcagacagaaaatgttttagacataagaaccattgtagctaatgaatatgcggtaaaaacgagtgcattagagtgggatgttactgacattgtaaaaaatgcaatcatagggggaatctcttttataccctcagttggccctgctatatcttttttagtcggtttattctggcctcaatcgaaagaaaatatatgggaagggattgtcaaacaaattgaaaggatgatagaggagtctgcgttaaagacgattaaaggtatccttgcaggtgatattgcatatatacaagagcggatggcaaccgttgctgatcttcttgataagcacccaggatcagaagaagcgaggagtgcttttaataacctggcagaaaatatagacggttatcacaaaaaatttaataatttttccgatgatgttaactatcagatattacccatgttttctactacggttatgatgcagataacatattgggttgctggtttagagagaaaagatgaaattgggcttagtaatatcgatattgaaaaagtccgaggattaattaaaaagacggtagaacaggctaatagctatattaataatatatatgatagagagttaaatgatgctcttaataactcgacggctgatactgttgcaaataatgtgatgtctgttcatggtcactgtcgtttacatggaattgaatatatcagtatttgggatagattaagtgaagctgagtctgtaaataatagaatctatgttgatgttttaagttattctactttctttgaccgtcaaacagcaaaagccagaattcaggcattgactccagagaaagatatgactccacctctcaaaccggctcttaatggaggaaaaagaagaaagatagattcgttaacgggacatattgtgcgtattggcggggcagcgagggtaggagggctgaccgttgtatttgatgatggtagtcgccatcaattaggtacaatatctagtgaaacgtcatctatttctctgaatggtagtcgaattaccagtttggaagtttggggcaatggtgctgttgatcaagcggtctttactttgagagatggtcgttcattgtcattaggttctcctggaacatctcggtataggaaatttcatgtcggtgaaagccactatattgcagggatatatttgtccagtgattacagcccattagccggtcaggcagcaaatattgctgtatcttatcaactgataaatgacgatgaaagataa

SEQ ID NO: 190 - DNA, 1263 bp, Photorhabdus Sp.
attatgcatacagaaaatgttttagacatcagaaccattgtggctaatgaatatgtggtaaaaacgagtgcattagagtgggatgttacggatattgtaaaaaatgcaatcatagggggtatctcttttataccttcggttggtcctgcgatatcttttttggtcggtttattctggcctcaatcgaaagaaaatatatgggaaggaattgtcaaacaaattgagaggatgatagaggagtctgcgttaaagacgattaaaggtatccttgcgggtgatattgcctatatacaagagcgcatggcaaccgttgctgatcttcttgataagcatccaggatctgacgaagcgaggagcgcctttaataacctggcagaaaatatagatggttatcacaaaaaatttaataatttttcggatgatgttaactatcaaatattacccatgttttctactacggttatgatgcagataacctattgggttgctggtttagagagaagagctgaaattgggcttagtgatattgatattgaaaaagtccgaggattaatcaaaaagacggtagaacaagctaatagttatattaatagtatctatgatagagagcttaatgatgctcttaataactcgacggcggacactgttgcaaataatgttatgtctgttcatggtcactgtcgtttacatgggattgaatatatcagtatttgggatagattaagtgaatctgagtctgtaaataatagaatctatgttgatgttttaagttattctactttctttgatcgtcaaacagcaaaagccagaattcaggcattgactccagagcaagatatggctccgcctctcaaaccagctcttaatggagggaagagaagaaagatagattctttaatgggacatattgtacgtattggaggagctccgagagtaggagggctgacagttgtatttgatgacggcagtagccatcgattaggtacaatatctggtgagacggcatctatttctctgaatggtagtcgaattaccagtttggaagtatggggcaatggtgctgttgatagagccgtctttactttgagtgatggtcggtttttgttatttggcgatcctggaacatctcgatataggaaattttatgttggtgatagtcactatatttcagggatatatttgtccagtgattacaacccattagcaggtcaggcagcaaatattgctgtatcttatcagttgataaatgatgatgaaaaatag

SEQ ID NO: 191 - DNA, 402 bp, Photorhabdus Sp.
atgtctagaataactatttttattgattcagatgaacaaaaatcagaatttaattctgattctcctgttccggtacgtaaagacttaaatacagttgttcctttgagtgatctgactatatcccctcgttctagtgtggaagtatttagaatagatacaccaataattccagaatccagaagatctctgagagttgtaaatacagggctggcaagtagtgttacggctaaattttactggtctcatagttttacctctgaatggtttgagtctggttctatcgatgtaggattaggagaagataaggtattaaacgtgcctaacaactctttttattatagtaaatttgttatctataataacacggataaagttgcttatattacggcaaatttggtttaa

SEQ ID NO: 192 - DNA, 402 bp, Photorhabdus Sp.
atgtctagaataactattgttgttgattcagatgagcagaaagcagaagtttattctaattctcctgttccagtacataaagacttaaatgcagttggtcctttgagtgaactgactatatcacctcatgctagtgtggaagtttttagaatagatacgccaataattccagaatccagaaaatctctgagagttgtcaatacagggctggcaaatagtgttacggctaaattttactggtctcatagttttacctctgaatggtttgagtctggttctatagatgtaggattaggagaagataaggtattaaatgtgcctagcaactccttttattatagtaaatttgttatctataataactcggataaagttgcttatgtgacggcaaatttggtctaa

SEQ ID NO: 193 - DNA, 402 bp, Photorhabdus Sp.
atgtctagaataactattgttgttgattcagatgaacagaaagcagaagtttactctaattcccctgttccagtacataaagacttaaatgcagttggtcctttgagtgatgtgactatatcacctcatgctagtgtggaagtatttagaatagatacaccaataattccagaatccagaagatctctgagagttgtaaataccgggctagcaaatagtgtcacggctaaattttactggtctcatagttttacctctgaatggtttgagtctggttctatagatgtaggattaggagaagagaaggtgttaaacgtgcctaataactctttttattatagtaaatttgttatctataataatacggataaagttgcttatgtgacggcaaatttggtttaa

SEQ ID NO: 194 - DNA, 402 bp, Photorhabdus Sp.
atgtctagaataaccattgttgttgattcagatgagcagaaagcagagttttattctaattcccctgttccagtacataaagacttaaatgcagttggtcctttgagtgatgtgactatatcacctcatgctagtgtggaagtatttagaatagatacaccaataattccagaatccagaagatctctgagagttgtaaataccgggctatcaaatagtgtcacggctaaattttactggtctcatagttttacctctgaatggtttgagtctggttctatagatgtaggattaggagaagagaaggtgttaaacgtgcctaataactctttttattatagtaaatttgttatctataataatacggataaagttgcttatgtgacggcaaatttggtttaa

SEQ ID NO: 195 - DNA, 402 bp, Photorhabdus Sp.
atgtctagaataaccattgttgttgattcagatacacaaaaagcagaagtttattctaattctcctgtgccggtacatagagatttaaatgcagttggtcctttgagtgatgtgactatatcacctcatgctagtgtggaagtatttagaatagacaccccaataattccagaatccagaagctctctgagagttgtaaatacagggttagcaaatagtgttacggctaaattttactggtctcatagttttacctctgaatggtttgaagctggatctatagatgtaggattaggagaagataaggtattaaacgtgcctagcagctctttttattatagtaaatttgttatctataataacacggatagagtggcttatgttacggcaaatttggtttaa

SEQ ID NO: 196 - DNA, 3285 bp, Bacillus Sp.
atggccgatatgtgggtgttagatagatacgataaccctttggcaatcctatctagtgatgcggaggatgatgcctgcacctttcattctgatcagtttctggaaaagttgaatcaaggtacagaattctctttcagttgtgacgcaagacacgaagatagcctacatgtaactaaattaaaccaagtcgttttcagagatgaagacggcttttttcgtctcttcaaaatcagagaaattgaccgcggcaacggagacaacggggcagagaaaatcgcccattgtgaaccggctgaaatggagttgcttgaagctattgtagaagacgtacggccaaccggtaaaacgcaacaatatgcactggatagagttttagagggtacaaggtggaagggaaatgtaacagctcaaacgggtacacagtccacaaacttttatcatatcagcgcttacgaagccattactaaaattattgaggtatggggcggagagctgcgttttactgtcaattttgacgaagaaaacaacaaaattattgaacgtgttgtcaacattgagcagcggcgcggaaatgatgaaggtgatcgtttcgaagtcggctacaatgtcgatagtattacggtcactgaaatggcttatcctgtttctgctctgtatggatggggcggcagcgtggagacagaaaatggcggggattcccgttacattgacttcgcagacgttgagtggaaagtatcaaacggtgatccggcagacaagccgaaaggtcagaagtggattgagcttccaggagcaaaagagaaatacggttacaaaaagtctgatggagcgtttataagctcttttggtcaatggcaggatgaaaacataaccgatccaaaagaactgttacagaaaacatatgaacatttgagggatacagcttccaaacctcaagcaacatatgaactaaaggtcattccgactgatcatatttctcttggagataccaggactgctatagatgacacacaagccgatccaatacagattcaatcccgagttatcgcccttggatacagtatttcaaatcctgctggcacaaaaaccgttgaaatgggcgagtttttagaagtttatcaacctgataggcgcctagacgatttagaagataaagtgaaaaatattgaccgcaatgttcaggtgactgacggaagtttccctgacattgtaccttcagtcccttctaatgtaactgttaaggggcttttttcaggtgtaagtattacttgggattatgatccttcttcttatattgcggcttatgaggtttatggatcacaaataaaaggattcaccccatctatcgaaaaccggctatggcgaggcaaacaaagcgggtacctacatgaaaacgctggcgttgataatgtttggtactatcgcattcgggctgttaactatcacagcaaagcaagcgaatttacagccgagttttcagcaaaaacccagcggattatgactgatgacattcttttcggcgcaatcacagcagacaagctggcaaatttagctgtaacagcggacgccatttcccgaaatttcgaagaagctaacattttgccgggatcgctattacgtttaagcgacattttaagggtcgattccagagtaagtgtcaatgaggtaaatggtttcaatgagttatccgttacgaaagacacaacagaatacacgtcattcggatttactacaggtggtagaaactcacttaagttaacgaaaggcgaaacttacaccttatcatttgagttgaaacgagaaacattgaatgacttttcgtatatacaggtcaggtcgaaaagtggcacgcagtacaatttaacgaacaacttcaccgatttgtcgagttatccaactgatgaatttgtaaggttcgatcttccttttgtttccccggcaactctaactgatggtcgcgtttgtctaggagggagaacacaaaatctcacagataacgctaacttcacaataagaaaagtgcagattagaagagggaacgtaagaatgcctttcggattcagcccatacgacacacaactcactgacggtgctgttacatctgccattattgcggatgcggctatcacaagcgccaaggtagcagaggcggccataggaacagcagccattcaaaatgcggcaattgcaagagctcttttacaaaaagccattattgccactgtccatatcgctgatgcagccatcacaagtgctaagatcaaagaactgtccgccgatttgattacgtcaggaacgattaacgcaatcaacatcacgggttcattgatcagaggcggtaaattccaagcgcttaatacaaacagtaactttgactcttattttgatggtgacaagctatatcagtacaagatgaatagcaaaagtcaatatacaaaactagatataagctctagtttgatatatcaagaggctggggccgattattcaatcgacggatcaaagccggaaatttggcgaagtgtaagtatcggtaatgggaaagtttcggtaaaaggttcaggagaatttacgaatgcttccaatatggccgtggtgggaatgtatggagattttaacggttatggggatggtatagggaaatttgtaatcagaaacgaaacgaatacatctgtaccatctgacatttttacattagagggtggataccgccctatgaatggtacagggggagagcaaaattatttctcgaactttaaaaatagagcggagataacgggtagttctacacttgctagttttcagacttcggattttgaagcgtatgttagcggtggactacgattcagatcaacaaaacgaactgtattcgagggcgcgcccgttgaattacctaaaaaatcaacaataatgccgggcgatgaccaatttacaacgccagaaaaaattgtcggcggcaacgtaacgtcattggttacagacattcacggagcgttacaaaataacttatgtattaatgtgtcacaatgcactgtaacagtaggaagtggttcatatggttatggttatgtttcttatcctatggttgatggtaacaatcaaggagcagaaaatgtgtttgctgtcatggcaacaccctacgggaaaaatgccaataatgtaacagcagggataatgaaccaaaccgcaaacggatttcaggtccatgtcagagggacaggtgcgaaagatgtaaccaatgaacggattacagttaggttagtgatcttttacgaaaaaaaataa

SEQ ID NO: 197 - DNA, 3303 bp, Bacillus Sp.
atggccgatatgtgggtactagatagatacgataacccgttggcaatcctatctagtgacgcggaagacgatgcctgcaccttttattctgatctgttcagggaagaactgaaccaaggtgcggaattctccttcagttgtgacgcaagacacgaagatagcctacatgtaactaaattaaaccaagtcgttttcagagatgaagacggcttttttcgtctcttcaaaatcagagagattgatcgcggtaatggagacaacggggcggagaaaatcgcacattgtgaaccggctgaaatggagctgctggaagctattgtggaagatgtacggcccacagataagacacagcaatatgcgctagatagagtattagagggcacaaggtggacgggtaaagtcacagctcaaacaggcacacagtcgacaaacttctaccatatcagcgcatacgaagccattactaaaattattgaggtatggggcggagagttgcgtttcacagtcaattttgatgaagaaaacaacaaaatcattgaacgtgtggtcaatattgagcaaaggcgcggaaatgatgaaggtgatcgttttgaggttggtttcaatgtcgaaagtataaatgtcactgacatggcttatccggtttctgccatgtatggctggggcggcagcgtggaaacagaaaacggcggagattctcgatttattgactttgcagacgttgaatggaaagtttcaaacggcgatccggcagataaaccgaaaggccaaaattgggttgaactacctggcgcaaaagagaaatacggatacaaaaaggctgacgggacgtttataaactctttcggccaatggcaggatgaaaacataaccgagccaaaagagctgttacaaaaaacatttgaatatctcgaaaacacagcctccaaacctcaagcaacatatgaattaaaggtcattccgactgataaaatttcacttggtgataccaggacagcgatagatgatacacaggccgagccaatacaaattcaatcgcgtgtaattgccctggaatatgctgtttcagatcccgacagcacaaaaaccgttgaaatgggcgagtttttagaagtttatcagcctgatagacgccttgacgatttagaagaaaaagtgaataacattgaccgtaatgtcaaggtgactgacggaagtttccctgacattatcccgaaagtcccttcaaacgtaactgttaaggggcttttttcaggtgttagtatcacttgggactatgatccttcttcttatattgcagcgtatgaggtttatggatcgcaaacaacagggtttaccccgtcaatcgaaaaccggctatggcgaggcaaacaaagtggtttcctgcatgaaaacgctggcgttgataatgtttggtactatcgcattcgggctgttaactatcacagcaaagcaagtgaatttacagctgaattttcggcaaaaacccagcgaattatgaccgatgacattcttttcggtgcaattacagcggacaagctggcggatcttacaattactgcggagaagttgtctacgacactacagggacaaaaccttttgcctggctctatgttgcgaaattacgatgaaacttatcgcttaaatgcctcaacgagatacctggatacctcaaaggaattcaacgaaatgcgtattgtcaaaacgcgcacggacgagcctttattcggtatgacattcaccccaagatcaaaactgaatttaagcaacggtatgacttatacgctttctttcgaattgaaaagatcaacaatatcgaatttcagctatttgagaataagagtcgatgggaaagaagtatatgcgataccaaacaatctgtctgatatatctagcgctgaccctgatcaatttctgagatatgatgtagtatttacgccaaatatcactataacaaatggagctttatggattggcgcaactaccgcaaacgcaactgatccaggcgaattcacaataagaaaaatccaagtcagagaaggtgacgtgaggaaagaattcactttcagcccttacgatactcagttaattgatggagcagtgacaagcgctatcattcaggatgcagccatcacaagcgccaaagtagcagaagcggccataggtacggcggccatacaaaatgctgctattgcacgagcgcatttgcaagaggccattattgacactgtccatatagctgatgccgccattacaagtgccaagattaaagagctgtccgccgatttgattacgtcaggaacaatcaaggcaatcaatatcacgggttcattgatcagaggcggtaaattccaagcgttgaacacaaataacaacttcgattcttattttgatggagacaagctatatcagtacagaagatccactgcctcaggaacatatggggaatacacaaaattagacgtgcagtctagccttatatatcaagagagcggatatgtagactctgacggttcaaatcaagaaatctatcgaagtgtaagcataggggatgggaagatttcagttaaagggactggtagaacctcaaccgaaagcgatgtccccgttgttgaaatgtacggctctaaaggaagcggcactacaggtgtacaaggaattatagagatttccaacgaatcgcctacaaatagaccgaaagatattttcacactgacaggagaggtaagctctattgacattgatgaattaaattatttttcatcattccaaaacagagcgcgtgtttccggttcttccactttattagaattaaaacctagcaatgcagaaattgacgtctcaggcggtctaagggtgaaggcatcaaagcgtactgtattcgaaggagcgcccgttgaattacctaaaaaatcaacaataatgccgggcgatgatcaatttacaacgcaagaaaaaatagttggtggaaatgtaacatcactagtcacagacattcacggcgcgttgcaaaataatctgcttgtttgtatcactcaaatagatgtagctttgggcgcttctggcggagcatatgcatacgcctataaatggtacaatatggttgatggtaactctcaaggagcggaaaacattttcgctgtaatggcgacaccttatggcaaaaatgcgaataacgtcaccgttggtataatgagccagagttctgaaaaattcgctgttcatgtaaggggaacaggagcgacagacgtggcggcaacaacagtcaccattagattggctatattttacgaaaaagcataa

SEQ ID NO: 198 - DNA, 3375 bp, Bacillus Sp.
atggccgatatgtgggtgttagatagatacgataaccctttggcaatcctatctagtgacgcagaggatgatgcctgcacttttcattctgatcagtttctggaaaagctgaatcaaggtacagaattcaccttcagttgtgacgcaagacacgaagatagcctacatgtaactaaattaaaccaagtcgttttcagagatgaagacggcttttttcgtctcttcaaaattagagaaattgaccgcggcaacggagacaacggggcagagaaaatcgcccattgtgaaccggctgaaatggagttgcttgaagctattgtggaagacgtacggccaaccggtaaaacgcaacaatatgcactggatagagttttagaaggcacaaggtggaagggcaatgtaacagctcaaacgggtacacagtccacaaacttttatcatatcagcgcttacgaagccattactaaaattattgaggtatggggcggagagctgcgttttactgtcaattttgacgaagaaaacaacaaaattattgaacgtgttgtcaacattgagcagcggcgcggaaatgatgaaggtgatcgtttcgaagtcggctacaatgtcgaaagtattacggtcactgaaatggcttatccagtttctgctctgtatggatggggcggcagcgtggagacagaaaatggcggagattcccgttatattgacttcgcagacgttgaatggaaagtatcaaacggtgatccggcagacaagccaaaaggtcagaagtggattgagctaccaggagcaaaagagaaatatggttacaaaaaggctgacggaacgtttataaactccttcggccaatggcaggatgaaaacataaccgatccgaaagagctgttacagaaaacatatgaatatttgagagacacagcttccaaatctcaagcaacatatgaactaaaggtcattccgactgatcatatttcccttggagataccaggactgctatagatgatacccaagccgatccaatacaaattcaatcccgagttatcgcccttggatacagcatttcaaatcctgccagcacaaaaaccgttgaaatgggcgagtttttagaagtttatcaacctgataggcgcctagacgatttagaagataaagtgaaaaacattgaccgcaatgttcaggtgactgatggcagtttccctgacattatccctaaagtcccttctaacgtaactgttaaggggcttttttcaggtactagcatcacttgggattatgatccttcttcttatattgcggcttatgaggtttatggatcacaaataaaaggtttcatcccatctatcgaaaatcggctatggcgaggcaaacaaagcgggtacctgcatgaaaacgctggcgttgataacgtttggtactatcgcatacgagcggttaactatcacggcaaagcgagcgaattcacagcagagttttcagcaaaaacccaacggattctgactgatgatattatgttcaacagcattatcgcggatcgtctggcaaacttggcggtcacggctgataaactggcacgcaactttgaccaaggcaatatcttcccaggctctcttttaaaggcgaaatggttttacgattacacatatacctctcatacagtagaggaaaaagaatttaatgaaatgacggtttctcagactcaattaactgatcaattattttttggtgtttgtgggttaagaatagcgccgaataatatccaaagaatgaagcttgagcaagggaaaacatacactctttctttcgaagtgaaaagaaataacacaactgatttgaactatattcaccttaaagaaacaaattcatggtacaggataagtggcacagatttatcagacatttcttcttatccttctgatcagtttgtcagggttaatattaaattcacagcccctacgacaagctctgtatatacaataggcatcggcggctttaacaggaataacaatacagagttatgctcgttcgtcattcgaaaattgcaagttcgcgaaggcgatacgataaaggagtatggatacagtccttatgacacacaactaacggacaacgttattgacggtgattacatccaagccctttctatcggatctgctcatatacaagaggcagcgataggaacagcacacatccaaaaagcagccataacaagtgcgcaaattgctgaggcggcaataggaacagcagctattcaaaacgctgctatcgcaaaagctcacctgaaaacagcgataattgataccgtccatatcattgacggagccattacaaatgccaagatcgggagcttgtcagctgacaaaataaattctggtacgattaattctattaatattacaggttcattgatcaaaggcggcaaattccaagcattgaacactaaccgtgattttgattcttattttgatggagacaagctatatcagtacagaagatccactgcctcaggaacatatggggaatacacaaaattagacgtgcagtctagccttatatatcaagagagcggatatgtagactctgatggttcaaaccaggaaatctatcgaagtgtaagcataggggatgggaagatttcagttaaagggactggtagaacctcaaccgaaagcgatgtccccgttgttgaaatgtacggctctaaaggaagcggcactacaggtgtacaaggaattatagcgatttccaacgaatcgcctacaaatagaccgaaagatattttcacactgacaggagaggtaagctctattgacattgatgaattaaattatttttcatcattccaaaatagggcgcgtatttcaggttcttctactttattagaattaaaacctagtaatgcggaaattgatgtttcaggcggcatacgaatgaagtcgtcgaagcgaacaatattcgaaggtgcgccagtcgaactgccaaaaagctcaataatatatccaggagacagccaatacactaccgcagaaaaaatcgtaggcggcaatgtaacttctcttgtcacagatatccacggagaattacaaaacaacatgtgcatatgcgttactcaatgtgatgttgtattaacgagtggtggatcatatgcctatggttatactacgatcaactttgttgatggaaattcacaaggtgcagaaaatatttttgctgtgatggctacaccttacggatctaatgccaataatgtgactgcggggataatgagtcaatcctctaaaggctttcaagttcatgttaggggaacaggcgcaaaggatatgaccagtgcatccataacggtaagattagttgtcttttatgaaaaaacataa

SEQ ID NO: 199 - DNA, 2961 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgcaggggtcatcttgttaagagaggatgagaatcctttagatcacgcgccattgcaagaaggacaaccgaaaaacttctctgatatcaaacaaccactattggaattacagttgatgtctaatgaaaccaaaatttctttatatggacgaagaagtgaacaacgcttggcacaagttgcaccatactcaagtgtccctttccatttgaccggtcgattttatgggccctatcctaagtggatcgcggaaagtgacaatgaacaagggggctattatcaagattcattcgttcctacctatcgtatgattttacgatttgttcccagatag

SEQ ID NO: 200 - DNA, 2961 bp, Enterococcus Sp.
atgaaaagcaaaataaatagtaaaaaaataatcatcttaatgactgtattagtgattcttttgacccatctaccttttcattttgcctatggatcagaaactagtgaacttgcacccgaaagccaaaatgatccaagtttaggagtagagagaaatgcaacaatcacatttgaaactagcccttcagaaggtggtagacctagttatatacctcatataactccgccagggggagatttattatacactatcagtgcaaatccgaaccaagggtttcgttttgttcgatgggagctaatcaacggatggaatgcttcgataggcaatctaaatgcagaaacaacaagtcttactatctctactgatggccctataggaccaccagtgcatgagacgataacgatacgagcaatatatgagagggtttacaatttaactttccaatcttctccaaatgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacattcattacgatgggggcaggagattcgtccattcgagcagtctatgaacaaatcactcatagtgtgagtgtgcaggccaatccaacgattggtggaaatcctacggtttcagcttcatccgctgcccaaggagcaaccatcaatttgaatgcgaatccagctgtcggatatcggtttgtcaattggcagtttctaacccaaaacggagcgacgattacaaacagtaatcttgcgaataccagtttacgaatgggtacgggacctgtgagcgttcaagccaattatgaacgcttgcaacaaggcagtgtcgtcgtaaggtatgtggacgaagagggtaatgagatagctcaaagcgatattttaacgggatttagcggagaagcatatcgtacagaagcaaaagaaatcgaagggtgggaattgcttgttgcaccggaaaatgcaacaggggttttcacgaatgttgagcaaatagtcacctatacttatcggaagaaccagcagttatggggaactgtcccttgggaatacgacgaggcaacgaaaacgatccatttgtatggtggaatcggtggatcggtcccagaagcgccatggaaaagccattccgaagttgaaacgatcattgtcaccaacgaggtatttttaccggaaaatagcgcatctctttttaacggagcaagacagttagaaagtattgaaggtgtagggaattttaatacatctaaggtaacgaatatggatgagatgtttgcccatactttggcgctaaaagagctagatattagtcaatgggatgtgtctaatgtaactagcatgagtcacacatttgcttggatgaccaatttaagaaagctagatgtcagtcaatgggatgtgtcaaatgtgacaacgttgactcatgcatttgcgtggacatccaaccttgttgatatagatgttagtcaatggaatgttggtaaggtttctagcatgagcaatttatttatgtcttcctcttcgctagctgaattagatttgagcaattgggacacaagaaataaaaatatcagtggcatgttctatcttgcatcaagactttcatcccttaaattaggagaagaatcagttatcggaaataccagcttacgaaatatcgttcctacagcggagtatacaggacgatgggtgcttgaagaaagtttggatagttcagttcgaaccatcgcgtttgagaattcaaacgaatttatggcaaattatgacggaaatcatccaggaacttatgtatgggagcgttctcgtccggaagaattagtggcagcattagagccattaagtgaccaatcaacagcaatcactggctggatgacagaagtaacggataatcgaacgatcacctatcaaaatacagcgggacaaacggtcactgtaactaaagaatcaccgaggatcaagtggggagattaccaagatgcagatcaacggattcgacagtttgagatacccttagcagaaaatgagcgtttagcaacagacacagaggtaacgctcactgtttctaaaccatccgtcgaaacaactggtgatttgacgattgacaaaaaggtaatcaaaggtctcgactacactgcaaatcacttcactttggagcgtaagaagttagaggcattaaccagtcaagcagaactccatgaattgattctgaaggaaagtcaggcaacagcacacgatgttttgacacaggacgatcgcagtcaggaaattaaaatcgtggctacagatttaaccaaggatgaagtggacgatggcacgtatttcgctacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagactacgagatccgtaatcattcagatctttctgttgatacgtatgtaaatcagttcattattgaagatgatgcaggggtcaccttgttaagggaggatgaaaatcctttagatcacgcgccattgcaagaaggacaaccgaaaaacttctctgatatcaaacaaccactattggaattacagttgatgtctaatgaaaccaaaatttctttatatggacgaagaagtgaacaacgcttggcacaagttgcaccatactcaagtgtccctttccatttgaccggtcgattttatgggccctatcctaagtggatctcggaaagtgacaatgaacaagggggttattatcaagattcattcgttcctacctatcgtatgattttacgatttgttcccagatag

SEQ ID NO: 201 - DNA, 2634 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgca

SEQ ID NO: 202 - DNA, 2526 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttcaataccgacgaaaatggtgttcgaatccctctactaa

SEQ ID NO: 203 - DNA, 2523 bp, Enterococcus Sp.
ttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtccatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgcaggggtcatcttgttaagagaggatgagaatcctttagatcacgcgccattgcaagaaggacaaccgaaaaacttctctgatatcaaacaaccactattggaattacagttgatgtctaatgaaaccaaaatttctttatatggacgaagaagtgaacaacgcttggcacaagttgcaccatactcaagtgtccctttccatttgaccggtcgattttatgggccctatcctaagtggatcgcggaaagtgacaatgaacaagggggctattatcaagattcattcgttcctacctatcgtatgattttacgatttgttcccagatag

SEQ ID NO: 204 - DNA, 2451 bp, Enterococcus Sp.
acgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacataccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgcaggggtcatcttgttaagagaggatgagaatcctttagatcacgcgccattgcaagaaggacaaccgaaaaacttctctgatatcaaacaaccactattggaattacagttgatgtctaatgaaaccaaaatttctttatatggacgaagaagtgaacaacgcttggcacaagttgcaccatactcaagtgtccctttccatttgaccggtcgattttatgggccctatcctaagtggatcgcggaaagtgacaatgaacaagggggctattatcaagattcattcgttcctacctatcgtatgattttacgatttgttcccagatag

SEQ ID NO: 205 - DNA, 2391 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcatcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatcgtggctacagatttaactaaggatgatgtggacgatggcacgtatttcgccacatttcaagtagggaacaaagcctatcaatttacaataggcattgatgttaattcgaagatccatcatctaaaagtttccataccgacgaaaatggtgttcgaatccctctaccaaggcgaggaaactaatcgtgaatttgttagtccagattacgagatccgtaatcattcagatctttctgttgatacgtatgtaaatcagttcattattgaagatgatgca

SEQ ID NO: 206 - DNA, 2358 bp, Enterococcus Sp.
atgaaaagcaaaaaaaatagtaaaaaaataatcatcttaatgaccgtattagtgattcttttgacccatctaccttttcattttgcctatggatcagaaactagtgaatctgcacccgaaagccaaaatgatccaagtttaggactagagagaaatgcaacaatcacatttgaaacaagtccttcagaaggtggtagacctagttttgcccctcatataaatccgccatggggaagtttattatacactatcagtgcaaatccgaaccaagggtttcgttttgttcgatgggagctaatcaacggattgaatgcttcgataagcaatctaaatgaagaaacaacaattcttagtatctctactggtggccctataggaccaccagtgcatgagacgataacgatacgagcaatctatgagagggtttataatttaactttccaatcttctccaattgctggaggaaatccaagagcggatcaaacaatactggcacaaggtgaaacgaccacgatccatgccaacgtttcgaatggatatcgctttgttcaatgggaacttgtttctggaaacacgactatcgcaaaccgaacgagtcaaagtacatccattacgatgggggcaggagattcgtcaattcgagcagtctatgaacaaatcactcatagtgtgagtgttcaggccaatccaacgattggtggcaatcctacggcttcagcttcatccgccgcccaaggagcaaccatcaatttgaatgcgaatccagctgtcggatatcggtttgtcaattggcagtttctaacccaaaacggagcgacgattacaaacagtaatcttgcgaatactaatttgcgaatgggaacgggatctgtgattgttcaagccaattttgaacgcttgcaacaaggcagtgtcatcgtacgatatgtggatgaagtgggaaacgagttggctcaaagtgatattttaacgggctttagcggagaatcctatcgcacagaagcaaaagcaattgaaggctgggaattgcttgcaatcccagtaaatgcaacaggttttttcacgaatgttgagcaaatagtcacctatacttatcggaagaaccagcagttatggggaactgtcccttgggaatacgacgaggcaacgaaaacgatccatttgtatggtggaatcgctggatcggtcccagaagcgccatggaaaagcactttcgaagttgaaacgatcattgtcaccaacgaggtatttttaccggaaaatagcgcctctctttttaacggggcaagacagttagaaagtattgaaggtgtagggaattttaatacatctaaggtaacgaatatggatgagatgtttgcacgtacttcggcgctaaaagagctagatattagtcaatgggatgtgtctaatgtaactagcatgagtcacacatttgcttggatgagcaatttaagaaagttagatgtcagtcaatgggatgtctccaatgtgacaacgttgagccatgcatttgcgtggacatccaaccttattgatatagatgttagtcaatggaatgttgggaaagtgatcgatatggggaatttatttatgtcttcctcttcgctagctgaattagatttgagcaattgggacacaagagataaagatattaggggcatgttccatcttgcatcaagactttcatcccttaaattaggagaagaatcagttatcggaaataccagcttacgaactatcgtacctacagcggagtatacaggacgatgggtgcttgaagaaagtttggatagttcagttcgaaccatcgcgtttgagaattcaaacgaatttatggcaaattatgacggaagtcatccaggaacttatgtatgggagcgttctcgtccggaagaattagtggctgcattagagccattaagtgaccaatcgatagcaatcactggctggatgacagaagtaacggataatcgaacgatcacttaccaaaatacagcgggacaaacagtcactgtaaccaaagaatcaccgaggatcaagtggggagattaccaagatgcagatcaacggattcgacagtttgagatacccttaacagaaaatgagcgtttagcaacagatacagaggtaacgctcactgttgctaaaccatccgtcgaaacaactggtgatttgacgattgaaaaaaaggtaatcaaaggtctcgactacactgcaaatcacttcacattagagcgtaagaagttagaggcattaaccagtgaagcagaactccatgaattgattctgaaggaaagtcaggcaacagcacacgatgttttgacacaggacgaccgcagtcaggaaattaaaatc

SEQ ID NO: 207 - DNA, 3015 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcaccggatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 208 - DNA, 3015 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggtacagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatgtgcagatcagtgaccgtcgtgtcgccaatgagcgcaatggatggcaattatcagttactcagaacggacaattccgtaatgaaagcggacatgaattgattgggtctgaaatccagttattcaatcaagaactagtgactgcacaaggcgggactaaacctgaactacaggaagaacctgtacaaagaatcgtaccaaatacaaggaaagtactcatacaagcaaacggagaatctggtacaggaacgtggatctatcgttttggggatcaacaaacggcagataaaagtgtcggtctctatgtccctggagggacaaatccagaagcaactagttattcgaccaagctgacatgggaattaagtgcagttcctggtaattaa

SEQ ID NO: 209 - DNA, 3015 bp, Enterococcus Sp.
atgaaaattaaaaaagtcttgattgtggcaagtgttagtcttctttgttttccttcgctctttttctcagtgatttcaacgagtatgcctgtgtctgccattgagaattctgtggaactatcgagagaatcagaattgatggatccactgaccagtacaacagaaacaaaggcgcctattttttcattcgaagaaaatcaagagccatctatagcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaaatccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcaccggatatttctgaaagtgaaaagtatcatacaacggcagatgagaatggggattatcgctatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaatcccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatgtgcagatcagtgaccgtcgtgtcgccaatgagcgcaatggatggcaattatcagttactcagaacggacaattccgtaatgaaagcggacatgaattgattgggtctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 210 - DNA, 2904 bp, Enterococcus Sp.
atggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaatgaaagcggacatgaattgattgggtctgaaatccagttattcaatcaagaactagtgactgcacaaggcgggactaaacctgaactacaggaagaacctgtacaaagaatcgtaccaaatacaaggaaagtactcatacaagcaaacggagaatctggtacaggaacgtggatctatcgttttggggatcaacaaacggcagataaaagtgtcggtctctatgtccctggagggacaaatccagaagcaactagttattcgaccaagctgacatgggaattaagtgcagttcctggtaattaa

SEQ ID NO: 211 - DNA, 2865 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaatcccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatgtgcagatcagtgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcgaccaagctgacatgggaattaagtgcagttcctggtaattaa

SEQ ID NO: 212 - DNA, 2835 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatatgcagatcagtgaccgtcgtgtcgccaatgagcgcaatggatggcaattatcagttactcagaacggacaattccgtaataaaagtggaaatgaattaattggctctgaaatccagttattcaatcaagaactagtgtctgcacaaggcgggactaaacctgaactccaggaagaacctgtgcagcaaattttaccaaataca

SEQ ID NO: 213 - DNA, 2613 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacg

SEQ ID NO: 214 - DNA, 2583 bp, Enterococcus Sp.
atgaaaattaaaaaagttttggtcgtggcaagtactagtcttctttgttttccttcgctctttttttcagtgattacaacgagtgtgcctgtgtttgccatcgagaattctatggaactacctagtacatcagaattgccggatccattggcaagtaaaatggaaacaaaggcacctattttttcatttgaagagaatcaagagccacaaatggcaaataaacagtttcaattagttgtacgttccagtcaagatgtttccgagtttgtattgaatctcccagagggagtcagtatcctagaagataagcaatctaccgatataaaattcaaaaatatagaagggaatcagtggcaggtgcagacggattctccacaaatgaccttttccattccactagttggagaaaaagcaggagcatatgagatagcggttggagaatcaaaaacgatgcttaacattcaaccagaggagagtccacaaacgactgaacaagaaattatttcttcagaggaaaacgaaacagaaaagactggagaatcaacagtcgaagaagaagcgaatggagatagagaagagccctcatcaaccacagatacttcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggtta

SEQ ID NO: 215 - DNA, 3015 bp, Enterococcus Sp.
atgaaaattaaaaaagctttggtcgtggcaagtactagtctcctttgttttcctttgctctttttcccagtgatttcaacgcatattcctgtgtctgccatcgagaattccgcggaactaccgaaagcaccagtattgcttgatccgctgggaagtacgacagaaacaaaggtacctattttttcattcgaagagagccaagagccacatatggcaggtagacagtttgaattagtcgtacatgccagtcaagaagcttccgagtttgtggtggatctcccggagggagtcagtatcgtagaagacaagcgatctaccgatattaagttcaccaatatagaaggaaatcagtggcaagtgcaggctagttctccacaaatgaccttctcactccctctaattgtagaaaaagagggagaatatgaagtagctattggggagtcaaaaacgacgcttaatattcaagcagaggagagccgacaaaccagtgagcaagaaattatttcttcagaggaaaaagaaacagcgaataccgaagaatcaaaagtagaagaggaaatgagtgtatcaaatgacgaaccatcctcaactacagaaactacagaaaatcattcagaacaagtaatggaaaatgcccgttcaacaaaagaaacaggcgtccaagatgtggcaaattggcaggaatttattcgtgctttttctgatccaaccatttctaccattgagattagcaatgactttgaagtaccaataaccccattagataatcaaactagtttattaaccggtaataattcaaatgtttctggagctgcaacatttgtatatttaattaaatctagcatttcaagaactttaactattaatgggaatggccatcaaatagactttggttcagtatcattgggaatgtatcccgctacacataattctaattccccttggaatattacttttaatgatttagatgtctattcggggaattggtggggtttttttcaaactaccaatttaactatagcacagcattcagtttctaatattacattaaataatatcaatagctatgggaatgaactaatagccccttattatacaaatgttaatatttctggtgttgtaaataatcatattacagaaacatatacgtctaaatttaggacaaattggcgtgtgaatacagttaattcagttaatttagaaaccagaagcctaaggattaaagaaaacgcagagttaaatctaagctccgtcaatagcgggaatctcattattggattaggagggttgaacgctaacttaaccctggaaaaaaatgcacgtatcaatttggaatcaaatggtactagcgcaggagataatgctaatggattcggctccagcatagatattgttaacggtaatttaaccatgaatgaaggttccaaaattaacgtagtgactactcgtaatttttcagctttaaatttacggagtgcaaactccgtagtaaaaatagacaatggatctaagataaatattaattctacctcacatacttgggaaagtaatgctgcccataggaatttagtatacatggctgggggcagttcattatcaataggagaggaaagcgagttcaatattgaggctaaaggaagaggcgctgcggcttctaatattatccatatagctggtaatgcaaaattttcagttggtaaaaatggcacattaaatgttaaaagtgacagtacatcgatttctcaaagtttactatcttttacttctgctggctcaacctttcaattttccgatgctaaaagagtaaatttggaacgtactggggcgattaccggaacgtcgacatccaatgggttgattaatatcgcaggaaggacgggtttgttagatatcaatgttcagtcagtgaaacaatgggagagaggaaattttaatgcaacggccgatttttcatggatacctatcttcaatttgagtatacgctatacaggaattgttccccgtattgacactgtttcttcaatttcacaagaaacaacagacagttttaagcaacttttcactacacaaaatgtacaacggattttatttgaaaaaatcccagatgtcgaagtcactatggacccattaacagaaggtccgaatgaaattaattcttatacgatcactggaaaggcgaatcctaatagtgtgattcgtttctcaggagattcggcgatcccctcagccactatagattcgcccgatacctctgaaagtgaaaagtatcatactatggcagatgagaatggatattatcgctatgaactacctaaagatcaccgatttactgctgggagcaccgtgactgcttatgcttttttaaatggaaaaaatgatacagctagcacgatcgtagaggaaaaagtcgtaatgtcaccagtggacccattagatcccaagacggatgttaaaccggagaacaagcctgagatatcagaaaatcaaggacgcttgagcctagactttgtttctcaatttaacttcgggatacaaaggatatctaatagcgatcaaacatactatgcgcaaccgcaacgactattaaatgacgctggatcagtgaatgagagcgaggaacggccaaactatgtgcagatcagtgatcgacggccggataatgaacgcaacggttggcaattatcggttactcagaacgggccattcagtaatcaaagcggacatgaattgattggttctgaaatccaattatttaatcaagaattggtgtctgcacaaggcggaactgcccctaaactacatggagaacctgtacaacgaattttaccaaatacaaggaaagtattactacaagcagaagaagaatctgggacaggtacgtggatttatcgtttgggcgatagcaatacggcaaacaaaagtgtctgtctatatatacctgaaggagcgaatccagaagcaacaagttattcgacaaagttgacatgggaattgagtgcagttcctgataattag

SEQ ID NO: 216 - DNA, 2415 bp, Enterococcus Sp.
tcgcaaaatgatccagaacaagtaacagaaaatgctcggttaacaaaagaagcgagggttcaagatgtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcaccggatatttctgaaagtgaaaagtatcatacaacggcagatgagaatggggattatcgctatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 217 - DNA, 2349 bp, Enterococcus Sp.
gtgacgaactgggaagaatttattcaggctttttctgatcaaaccatttctaccattgagattagcaatgactttgaagtaccaacaactcctttagctaatcaaactggtttattaacaggtaataattcaaacgtttctggatctgcgacctttgtatatttaattaaatctagtatttcaagaactttaactatcaatggaaatggacatcaaatagactttggttcagtatccttaggaatgtatcccgctacacataatgaaaactctccttggaatattacttttaatgatttagatgtctattcggggaattggtgggtcttttttcaaactactaatttaactgtagtacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtaaaacaatgggcaagagggaattttgaagtgatacccgatcattcatggacacctatcttcaatttgaatctacgctatacaggagtagttcctcgaattgagactgtttcttcgattgcacaagaaacagcagatagttttaagcaatatttcactacgcaaaatgtccaacgtattttatttgaaaaaataccagatgtcgaagtcacgattgatccgttaacagaagatccgaaggaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 218 - DNA, 3003 bp, Enterococcus Sp.
atgaaaattaaaaaagtcttgattgtggcaagtgttagtcttctttgttttccttcgctctttttctcagtgatttcaacgagtatgcctgtgtctgccattgagaattctgtggaactatcgagagaatcagaattgatggatccactgaccagtacaacagaaacaaaggcgcctattttttcattcgaagaaaatcaagagccatctatagcaaataaacagtttcaattagtcgtacgttccagtcaagatgtttccgaatttgtgttgaatctcccagagggagtcagtatcgtagaagacaagcaatctgctgatagtaagttcactaatatagaaggaagccagtggcaagtacggacgaattctccacaaatgatcttttccattccactagttgtagaaaaagcaggagcctatgagatagctgtcggagaatcaaaaatgacgcttaacattcaatcagaggagagccaacaacccagtgaacaagaagtcacttcctcggaagaaaaagaaacagcgaagaccgaagaatcaacagtcgaagaagaagcgagtgtatcaagtgatgaaaaatcatcaaccatagataattcgcaaaatgatccagaacaagtaacagaaagcgctcgttcaacaaaagaagcgagtgtccaagatgtggcgaattgggaagagtttatccgtgcatttgtagatccgtcaataacaacgattaatgttgtttctgatttccaaacaccagataatcctcgactcaatctaacggatattacaacaggtggaacgagtaaccctaatggtgggacagcatttgtctatcttaatgtagctaatatctctagaaatctaacggtcgaaggaaatggtcatcaaattgattttcgcgcaatcactttatgttttaacaatattacggctaattcttcaactccttggaatatcacgttaaaagatttagagatataccacggaaactattatggaccgttgactttcaatgatttgaacgtgacgaatcaaactgctagtcaaattacttaccataatattacgaactacggaaatcaactgattcattcaccttatagtagtattaaattttcaggtaaatcaagtagtaaacaggtatcagcgtatacctccgcttttggtacgtggcgcatcaatgcactagatcaaacgaatatctatgcttcaaatttaacgatacttgaagatgctgaggttgaattagaaacaattagcgcaggtaatttagatttaggaggagttgtacaccccaataacaactttagaatggaaaaaaattcatctttaaatgctgtatcaaaaggaaatgctggcgaagctgatggcacaagtttactcgttcgaagaggcagtgttgaaatagatgagggcgcaaagctgaacttagtgccacaaaatttaagatcagcaatttctttacgtactgccaactcatcgctcagaataaaagaaaaaggcgtccttaccatcgattctcaaggaacaaaggcgaatgctaatggtgccctatataatattatttggatggcggcaggaagtaatctactagtagaaagcgggagtacactgaatattgttgccactgaaatggctgcctcaccatcgaatattttacatgttaatggaaatgcaacggtatccatcggcaaagatgctaccttgaatataaaaagtgacagtacttcaaacgctcaaaatttaatgtacttcgcttctactggttcaacctttgaattttctgatgctcaagaagtcaatttggaacgaactggaacgattgccggaacgtcaaccgccaacggattgattaatatcgcaggaaacactgggttattagatatcgatgttcaatcagtaaaacaatgggcaagagggaattttgaagtgatacccgatcattcatggacacctatcttcaatttgaatctacgctatacaggagtagttcctcgaattgagactgtttcttcgattgcacaagaaacagcagatagttttaagcaatatttcactacgcaaaatgtccaacgtattttatttgaaaaaataccagatgtcgaagtcacgattgatccgttaacagaagatccgaaggaagtgaattctcatacgattactggaaaggcgaatcctaatagtgtgatccgcttctcaggcgatccggcgattcctgcaggctctattacttcaccggatatttctgaaagtgaaaagtatcatacaacggcagatgagaatggggattatcgctatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaatcccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 219 - DNA, 3003 bp, Enterococcus Sp.
atgaaaattaaaaaagtcttgattgtggcaagtgttagtcttctttgttttccttcgctctttttctcagtgatttcaacgagtatgcctgtgtctgccattgagaattctgtggaactatcgagagaatcagaattgatggatccactgaccagtacaacagaaacaaaggcgcctattttttcattcgaagaaaatcaagagccatctatagcaaataaacagtttcaattagtcgtacgttccagtcaagatgtttccgaatttgtgttgaatctcccagagggagtcagtatcgtagaagacaagcaatctgctgatagtaagttcactaatatagaaggaagccagtggcaagtacggacgaattctccacaaatgatcttttccattccactagttgtagaaaaagcaggagcctatgagatagctgtcggagaatcaaaaatgacgcttaacattcaatcagaggagagccaacaacccagtgaacaagaagtcacttcctcggaagaaaaagaaacagcgaagaccgaagaatcaacagtcgaagaagaagcgagtgtatcaagtgatgaaaaatcatcaaccatagataattcgcaaaatgatccagaacaagtaacagaaagcgctcgttcaacaaaagaagcgagtgtccaagatgtggcgaattgggaagagtttatccgtgcatttgtagatccgtcaataacaacgattaatgttgtttctgatttccaaacaccagataatcctcgactcaatctaacggatattacaacaggtggaacgagtaaccctaatggtgggacagcatttgtctatcttaatgtagctaatatctctagaaatctaacggtcgaaggaaatggtcatcaaattgattttcgcgcaatcactttatgttttaacaatattacggctaattcttcaactccttggaatatcacgttaaaagatttagagatataccacggaaactattatggaccgttgactttcaatgatttgaacgtgacgaatcaaactgctagtcaaattacttaccataatattacgaactacggaaatcaactgattcattcaccttatagtagtattaaattttcaggtaaatcaagtagtaaacaggtatcagcgtatacctccgcttttggtacgtggcgcatcaatgcactagatcaaacgaatatctatgcttcaaatttaacgatacttgaagatgctgaggttgaattagaaacaattagcgcaggtaatttagatttaggaggagttgtacaccccaataacaactttagaatggaaaaaaattcatctttaaatgctgtatcaaaaggaaatgctggcgaagctgatggcacaagtttactcgttcgaagaggcagtgttgaaatagatgagggcgcaaagctgaacttagtgccacaaaatttaagatcagcaatttctttacgtactgccaactcatcgctcagaataaaagaaaaaggcgtccttaccatcgattctcaaggaacaaaggcgaatgctaatggtgccctatataatattatttggatggcggcaggaagtaatctactagtagaaagcgggagtacactgaatattgttgccactgaaatggctgcctcaccatcgaatattttacatgttaatggaaatgcaacggtatccatcggcaaagatgctaccttgaatataaaaagtgacagtacttcaaacgctcaaaatttaatgtacttcgcttctactggttcaacctttgaattttctgatgctcaagaagtcaatttggaacgaactggaacgattgccggaacgtcaaccgccaacggattgattaatatcgcaggaaacactgggttattagatatcgatgttcaatcagtaaaacaatgggcaagagggaattttgaagtgatacccgatcattcatggacacctatcttcaatttgaatctacgctatacaggagtagttcctcgaattgagactgtttcttcgattgcacaagaaacagcggatagctttaagcaatatttcactacgcaaaatgtccaacggattttatttgaaaaaattccagatgtcgaagtcacgattgatccgttaacagaagatccgaatgaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggagattatcgttatgaattaccggaagatcgacgattcactgctggaaataccgtgacagcctatgcttttttgaatgggaaaaatgataccgctagtacaattgtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtacaaagaatcgtaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 220 - DNA, 3003 bp, Enterococcus Sp.
atgaaaattaaaaaagtcttggtcgtggcaagtgttagtcttctttgttttccttcgctctttttctcagtgatttcaacgagtatgcctgtgtttgccattgagaattctgtggaactatcgagagaatcagaattgatggatccactgaccaatacaacagaaacaaaagcgcccattttttcattcgaagaaaatcaagagccatctatagcaaataaacagtttcaattagtcgtacgttccagtcaagatgtttccgagtttgtgttgaatctcccagagggagtcagtatcgcagaagacaaatctgctgatagtaagttcactaatatagaaggaggccagtggcaagtacggacgaattctccacaaatgatcttttccattccactagttgtagaaaaagcaggagcctatgagatagctgtcggagaatcaaaaatgacgcttaacattcaatcagaggagagtcaacaacccagtgaacaagaagtcacttcctcggaagaaaaagaaacagcgaagaccgaagaatcaacagtcgaagaagaagcgagtgtatcaagtgatgaaaaatcatcaaccacagatacttcgcaaaatgatccagaacaagtaacagaaagcgctcggtcaacaaaagaagcgagtgtccaagatgtggcgaattgggaagagtttatccgtgcatttgtagatccgtcaataacaacgattaatgttgtttctgattttcaaacaccagataatcctcgactcaatctaacggatattacaacaggtggaacgaataatcctaatggtgggacagcatttgtttatcttaatgtagctaatatctctagaaatctaacggtcgaaggaaatggccatcaaattgattttcgcgcaatcactttatgttttaacaatattacggctaattcttcaactccttggaatatcgcgttaaaagatttagagatataccacggaaactattatggaccgttgactttcaatgatttgaacgtgacgaatcaaactgctagtcagatcacttaccataatattacgaactacggaaatcaactgattcattcaccttacagtagtattaaaatctcaggtaaatcaagtagtaaacaagtatcagagtatacttcctcttttggtacgtggcgcatcaatgcactagatcaaacgaatatctatgcttcaaatttaacgatagttgaagatgctgaggttgaattagaaacaattagcgcaggtaatttagatttaggaggagtagtacaccccaataacaactttagaatggaaaaaaattcatctttaaatgctgtatcaaaaggaaatgctggcgaagctgatggaacaagtttactcgttcgaagaggcagtgttgaaatagatgagggtgcaaagctgaacttagtaccacaaaatctaagatcagcaatttctttacgtactgcgaactcatcgctcagaataaaagaaaaaggcgtccttaccatcgattctcaaggaacaaaggcgaatgctaatggtgccctatataatattatttggatggcggcaggaagtaatctactagtagaaagcgggagtacactgaatattgttgctactgaaatggctgcctcaccatcgaatcttttacatgttaatggagatgcaacggtatccatcggcaaagatgccaccttgaatataaaaagtgacagcacctcaaatgatcaaaatttgatgtacttcgcttctgctgggtcaacttttgaattttctgatgctcaagaagtcaatttggaacgaactggaacgattgccggaacgtcgaccgccaacggattgattaatatcgcaggaagtaccggtctattagatatcgatgtccaatcagtgaaacaatgggcaagaggaaattttgaagagatacctgatcattcatggacacctatcttcaatttgaatctacgctatacaggaattgtacctaggattaacgatgatgtttcttctattccacaagaaacagcggatagttttaaacaatatttcactacgcaaaatgtccaacgggttttatttgaaaaaattccagatgtcgaagtcacgattgatccgttaacagaagatccgaatgaagtgaattctcatacgattactggaaaggcgaatcctaatagtatgatccgcttctcaggcgatccggcgattcctgcaggctctattacttcacctgatatttctgaaagtgaaaagtatcatacaacggcagatgagaatggggattatcgttatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaatcccagaagatcaaggacgtttgagtctagattttgtgtcccaatttaactttgagacacaaaaaatatctgttagtgatcaaacgtattacgcccaaccacaacggttattaaatgaagatggaacggttaacgagacgaaagagcgtccaaactatgtgcagatcagtgaccgtcgtgccgccaatgagcgcaatggatggcaattatcagttactcagaacggacaattccgtaatgaaagcggacatgaattgattgggtctgaaatccagttattcaatcaagaactagtgactgcacaaggcgggactaaacctgaactacaggaagaacctgtacaaagaatcgtaccaaatacaaggaaagtactcatacaagcaaacggagaatctggtacaggaacgtggatctatcgttttggggatcaacaaacggcagataaaagtgtcagtctctatgtccctggagggacaaatccagaagcaactagttattcgaccaagctgacatgggaattaagtgcagttcctggtaattaa

SEQ ID NO: 221 - DNA, 2136 bp, Enterococcus Sp.
caaatagactttggttcagtatccttaggaatgtatcccgctacacataatgaaaactctccttggaatattacttttaatgatttagatgtctattcggggaattggtggggcttttttcaaactactaatttaactgtagcacaacattcagtttctaacattacattaaataatattactagctatggcaatgaattaattgccccttattatacaaatgttgacatttcaggtgttgtaaataatcatatcacagaaacgtatacgtctaaatttaggacaaattggcgtgtgaacacagttaattcagttaatttagaaaccaggagcctaacgatcaaagaaaacgcagagttaaatctaagctccgtcaatagtggtaatctaattattggattaggaggtttggacgctaacttaaccctggaaaaaaatgcacgtatcaatatagaatcaaatggtgctagcgcaggagacaatgctaatggacgtggctccagtatagatattgttaacggtaatttaattatgaatgaaggctctacaattaacgtaatgactactcgtaatttttcagctttaaatttacgaagtgcaaactccttagtgaaaatagatgatggatctaagataaatattaattctatctcacatacttgggctagtaatgctgcacatagaaatttagtatatatggctactggtagttcattatcagtaggagaagaaagtgagtttaatgttgaggctacgggaagaggcactgcagcttctaatattgtccatatagcaggcaatgcaaactttgcagttgataaagacggaacactagatattaaaagtgacagcacatcgacttctcaaagcttactatcttttgcttctgctggctcaacctttcaattttctgatgcgaaaagagtcaatctagaacgaactgggacaattgccggaacctcaacaaccaacggattgattaatattgcaggaagtactggtctattagatatcgatgtccaatcggtgaaacaatgggcaagaggaaattttgaggagacacccgatcattcatggacacctatcttcaatttgaatctacgctatacaggagtagttcctcgaattgagactgtttcttcgattgcacaagaaacagcggatagttttaagcaatatttcactacgcaaaatgtccaacgtattttatttgaaaaaataccagatgtcgaagtcacgattgatccgttaacagaagatccgaaggaagtgaattctcatacgattactggaaaggcgaatcctaatagtgtgatccgcttctcaggcgatccggcgattcctgcaggctctattacttcacctgatatttctgaaagtgaaaagtatcatacaacggcagatgagaatggggattatcgctatgaattaccggaagatcgacgattcactgctggaaataccgtgacagcctatgcttttttgaatgggaaaaatgataccgctagtacaatggtagaggaaaaaattgtggtggcacctgtggatccattagatcctgaaacggaagttgaaccggagaataaaccagaaattccagaagatcaaggacgtttgagtctagattttgtgtcccaatttaactttgagacacaaaaaatatctgttagtgatcaaacgtattacgcccaaccacaacggttattaaatgaagatggaacggttaacgagacggaagagcgtccaaactatgtgcagatcagtgaccgtcgtgccgccaatgagcgcaatggatggcaattatcagttactcagaacggacaattccgtaataaaagtggaaatgaattaattggctctgaaatccagttattcaatcaagaactagtgactgcacaaggcgggactaaacctgaactccaggaagaacctgtgcagcaaattttaccaaatacaagaaaagtactcataaaagcaaacggagaatctggtacaggaacatggatctatcgttttggggatcaacaaacggcaaataaaagtgtcggtctatatgtccctggagggacaaatccagaagcaactagttattcaactaagttgacatgggaattaagtgcagttcctgaaaactag

SEQ ID NO: 222 - DNA, 1029 bp, Providencia Sp.
atggcggtctattttgtcacgggtaaactcggctcaggaaaaacattgtctgccgtgtataaaatcaaagagtatttaatgcaagggcgcaaagtggccaccaatttaaatatctcactgaccggcatgtttggctatcacgctaaaaatattaaccttgttcgcatccctgataaacccaacttaatggatttagacgccattgggaaaggtaacctcagttatgacgagtccctcaatggcttattggtgttagatgaatgcggtacctggtttaactcccgttcttgggcagacaaaagccgacaagagttgattaactggtttgcccatgcccgtaagctcggttgggatattctgtttttagtgcaaagcctccatgtcgtcgataaacaaagccgtttaatgttcgcagagcatgtggtgtattgccgccgaactgaccgcttgagagtcccgtatattcactgggttttacaactggtgactttggggagattccagatgccaaaaatccatttggctatcgtcaaatacggcgattcaccgacggcactggttactgaccgctgggtttatcaaggctctccgctttatgcagcgtatgacaccaaacaacaattttcggatttctattctcatggggcgttttgtgtcttaccaccgcattattacgtgttaaaacgcgctcaaatcaacgtgggcttttttatgcgactcaccaaaatctacttcaagcgcgccaagcgattaagccttgtcttggccggcattctgttatgccttatcgggcaattcttttaccagaaatatgcaccggtcatgtctaaggaaacagggatactcctgacgaacatcaccattgactcagccattacccatggcaaccaaacccattaccaatttaaaacgccatctggcgtggtatccgaacaggtgttgattcaagatggcatcaccgtcacgccggtgtctgcttgccaagcccgtttaaccttgcgaggggtgtcctatgatatcgcgtgttag

SEQ ID NO: 223 - DNA, 2772 bp, Pseudomonas Sp.
atgcaaaccgacaacagcccgttgctcgctcaactgattgatcactcacgcccgcccgctcccggtcgggacgacttcaagaccgccctgcggcgcctcaacatccactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgccgcccgcttctgcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggttcccatgttgtcgatcgtcaaccagatcctgctcaaaaatatcgcgcaggccaaagaagaagatacctataaggtgctgagtgaaacttggtacccgttttccctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacgctgctgaaaagtagctgggtagccgaagcgggcgcgaaagcgttctatcacaactattacaactggaagactgatctgatcggaccggcaaaactcactgactttctgagccacacacaactggatgccgaccagcttcaggcactgcttgcactacagactcagtcaccacgccaatcgcctaactgcaagcaagaaaccagcctcacctacggtgcgtgctacatcaacggcacgaccacacccgctatcagcctggacaacgccaagctgaccaacatcagccttgagcgcttcgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagttcgctgcctggcttcatcaattacccgttcatgcctcaggcgaccgcgtgtcattgttcgaccaggtatttaatcgcaccgggtccgccctgccccccctgtatctggacagcgctacgttcgacgataccacccggcaacagctctgcgctgggttgggcctgcaagacacccaggattcgcttcaactactgatcaaccccaacaagcctgcaacccgtacgatcgagacagtcagcgagatctatcggcaagcgagaatcgctcgcctgtttggggtatcggtcgtggaatgccgacaactggtgcaaatgctcgggaatgcgaaccttctcatgcagttgcgccacccaacgttacgcaacaaaccgaagggcatgactgactttctcgatgtgctcatgcaactggaatgggccagccgttggtttaaagaaaacggcagcagcctggcgttgctcagatgccagctattgctggatcgccaggtccaggacccggtcatcaatcagctattgaaggagttcgccctctatgaccaagcgtccctttccaaagcgttgcaaccgcttgatcttcctcagcaaccccttgacgaaaaagatcgtttacccgccgttgactgggaagtcttggcctgtacggcgctgcaacagatgcgtcccagtaacaacatcgagacagcgctcgatcacgtgctctcttccgttcaaatcagcacggcgcctgcccgtacgacacagttaatcaaccaagcaaagtccaagctccacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcaccgctgcaaaccctcagttatctgatactgctgttacctcacgccgccgatattctgcaacttcccctcagctcacaagcacttcaccagttcctggtcaatccgcactggctcgcgcgcaagtacaagatgccctcgctgcttgaactgaccccgtacaacctctacctcatgcagcagttcaaacactgcatccaccactgcggcctgacggaagagcagcttctgaactacttcgaacacgccaatgccctgcccaacagcactgcgcaaaacaccagcgaagacacgaacgagcatctcgctcaacttttaggttggagtgccagtgaaatcgatgtgttcagcaaccaactcaaacctccacgcattacctcaatgaaccgcctggactgggtgctgcgctgccgccgagccagcatcgacacaggcctgcctgcccacatgctgatcaaagccagcgaactgaaagccgattctgcgtttgctgactggaagagcgtcggtgaggcgatcaccagtgcgtatccataa

SEQ ID NO: 224 - DNA, 2772 bp, Pseudomonas Sp.
atgcaaaccgacaacagcccgttgctcgctcaactgattgatcactcacgcccgcccgctcccggtcgggacgatttcaagaccgccctgcggcgcctcaacatccactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgcctcccgcttctgcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggttcccatgttgtcgatcgtcaaccagatcctgctcaaaaatatcgcgcaggccaaagaagaagatacctataaggtgctgagtgaaacttggtacccgttttccctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacgctgctgaaaagtagctgggtagccgaagcgggcgcgaaagcgttctatcacaactattacaactggaagactgatctgatcggaccggcaaaactcactgactttctgagccacacacaactggatgccgaccagcttcaggcactgcttgcactacagactcagtcaccacgccaatcgcctaactgcaagcaagaaaccagcctcacctacggtgcgtgctacatcaacggcacgaccacacccgctatcagcctggacaacgccaagctgaccaacatcagccttgagcgcttcgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagttcgctgcctggcttcatcaattacccgttcatgcctcaggcgaccgcgtgtcattgttcgaccaggtatttaatcgcaccgggtccgccctgccccccctgtatctggacagcgctacgttcgacgataccacccggcaacagctctgcgctgggttgggcctgcaagacacccaggattcgcttcaactactgatcaaccccaacaagcctgcaacccgtacgatcgagacagtcagcgagatctatcggcaagcgagaatcgctcgcctgtttggggtatcggtcgtggaatgccgacaactggtgcaaatgctcgggaatgcgaaccttctcatgcagttgcgccacccaacgttacgcaacaaaccgaagggcatgactgactttctcgatgtgctcatgcacctggaatgggccagccgttggtttaaagaaaacggcagcagcctggcgttgctcagatgccagctattgctggatcgccaggtccacgacccggtcatcaatcagctattgaaggagttcacccactatgaccaagcgtccctttccaaagcgttgcaaccgcttgatcttcctcagcaacccattgacgaaaaagatcgtttacccgccgttgactgggaagtcttggcctatacggcgctgcaacagatgcgtcccagtaacaacatcgagacagcgctcgatcacgtgctctcttccgttcaaatcagcacggcgcctgcccgtacgacacagttgatcaaccaagcgaagtccaagctcaacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcgccgctgcaaaccctcagttatctgatactgctgttacctcacgccgccgatattctgcaacttcccctcagctcacaagcacttcaccagttcctggtcaatccgcactggctcacgcgtaagtacaaggcgccctcgctgcttgaactgaccccgtacaacctctacctcatgcagcagttcaaacattgcatccaccactgcggcctgacggaagagcagcttctgaactacttcgaacacgccaacgccctgcccaacagcgcagcgaaaaacaccagcgaagacacgaacgagcatctcgctcaacttttaggttggagtgccagtgaaatcgatgtcttcagcaaccaactcaaacctccacgcattacctcaatgaaccgcctggactgggtgctgcgctgccgccaagccagcatcgacacaggcctgcctgccaacatgctgattaaagccagcgaactgaaagccgattctgcgtttgctgactggaagagcgtcggtgaggcgatcaccagtgcgtatccataa

SEQ ID NO: 225 - DNA, 2568 bp, Pseudomonas Sp.
cagaacgctgccacgcaactggaaaccttatttcgcgaacagcaagtctcgcctcccgcttcttcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggctcccatgttgtcgatcgtcaaccagatcctgctcaaaaatatcgcgcaggccaaagaagaagatacctataaggtgctgagtgaaacctggtacccgttttctctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacactgctgaaaagtagctgggtaaccgaaacgggcgcgaaagcgttctatcacaactattacaactggaagtctgatctgatcggaccggcaaaactcactgattttctgagccacacacaactggatgccgaccagcttcaggcactgcttgcactacagactcagtcaccacgccaatcgcctaactgcaagcaaaaaaccagcctcagctacggtgcgtgctacatcaacggcacgaccacacccgctatcagcctggacaacgccaagctgaccaacatcagccttgagcgctttgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagtttgctgcctggcttcatcaattacccgttcatgcctcaggcgaccgcgtgtcattgttcgaccaggtatttaatcgcaccgggtctgccctgccgcccctgtatctggacagtgccaggttcgacgataccacccggcaacagctctgcgctgggttgggcctgcaagacacccaggattcgcttcaactactgatcaaccccaacaagcctgcaacccgtacgatcgagacagtcagcgagatctatcggcaagcaagaatcgctcgcctgtttggggtatcggtcgtggaatgccgacaactggtgcaaatgctcgggaatgcgaaccttctcatgcagttgcgcaacccaacgttacgcaacaaaccgaagggcatgactgactttctcgatgtgctcatgcaactggaatgggccagccgttggtttaaagaaaacggcagcagcctggcgttgctcagatgccagctattgctggatcgccaggtccaggacccggtcatcaatcagctattgaaggagttcgccctctatgaccaagcgtccctttccaaagcgttgcaaccgcttgatcttcctcagcaacccattgacgaaaaagatcgtttacccgccgttgactgggaagccttggcctatacggcgctgcaacagatgcgtcccagtaacaacatcgagacagcgctcgatcacgtgctctcttccgttcaaatcagcacggcgcctgcccgtacgacacagttaatcaaccaagcaaagtccaagctccacacattgctgagcacggtgcgtgatgagttgtggtctttatatctacgccttaaagcaatcatccaagccgtcccacaagccccaagcgatgccaacggctatcagaaatacgacaatgaccagcatttcctgcgtttatatgcccccgctgctgcgccgctgcaaaccctcagttatctgatactgctgttacctcacgccgccgatattctgcaacttcccctcagctcacaagcacttcaccagttcctggtcaatccgcactggctcgcgcgcaagtacaagatgccctcgctgcttgaactgaccccgtacaacctctacctcatgcagcagttcaaacactgcatccaccactgcggcctgacggaagagcagcttctgaactacttcgaacacgccaatgccctgcccaacagcactgcgcaaaataccagcgaagacacgaacgagcatctcgctcaacttttaggttggagtgccagtgaaatcgatgtgttcagcaaccaactcaaacctccacgcattacctcaatgaaccgcctggactgggtgctgcgctgccgccgagccagcatcgacacaggcctgcctgccaacatgctgattaaagccagcgaactgaaagccgattctgcgtttgctgactggaagagcgtcggtgaggcgatcaccagtgcgtatccataa

SEQ ID NO: 226 - DNA, 2796 bp, Pseudomonas Sp.
atgaatatgcaaaccgacagcagccccttgctcgccaagctgattgatcactcacggcctcccgctccaggtcgggacgatttcaagaccgccctgcggcgcctcaacctcaactcggtattggacatcgtacgattgtccgaaagagcctttgccgagcaactggcaacgtacaacgatgacgatgcccacacggtgtacctcaaggcccagagcgccgccgcgcaactggaaacgttatttcgcgaacagcaagtctcgtcccctccttcttcaccgcgcaataaacgcagtctcccccccgagaccagcgcaacctaccaggccttgttcaaggaaaagtgggaccagttctgctccagttcgtctatcgcagcgctcgattcaccgactgcctacctgcgtgcgctctatttgttcgccctgcagctggaagaaaataccaaggacacaaacgcgctcaagctgtcgcagcgacgcccggaactcaaagaccaggtgatcaaccaacatagcgtttcgagccaggttcccatgttgtcgatcgtcaaccagatcttgctcaaaaatatcgcgccggccaaagaggaagatacctatagggtgctgagtgaaacctggtatccgttttctctgccctatcatttgcaccatcagcaatgccaacagggcctgtcgggcgacaagccggcgttgggtgagttgaactatcgcatcagtcgccagttgcctttggcaggagaaaccagcacttacgggcaggtcggcgaacagaacaacgaagtccaatgtcagttatcggggttgagccctaaccaacagacaatgctgaaagctaaatgggtcaccgaaacagaggtggaaaaagaggaaaaggtgaaaaagttccatctccagttttacaactggacgatagatcaaacaggaccagagaagctcactgactttctgaaccatacacaactggatgccgaccaacttcaggcgctgcttgcacaacagactcagtcaccacgccaatcacctaactgcaagcaaaaccccggcctcgcctacggtgcgtgctatatcaacggcacgaccacacccgctatcagcctggacaacgccaagctgacccacgttagccttgagcgcttcgacagactgcaacgcatgattcgtctacagcgctggctcggcctgcctttcgcgcaattggacaccctgatagtcagcgccatgcgctgcgaaggccatcgcaacagcacgctgcagatcacccataacaccctccgggcgctgggggtcttttgctatttgagcaaacgctacacgttgcaagccgaagaatttgccgccctgcttcatcagttacccgtccatgcctcaggcgaccgcatgtcattgttcgaccaggtgttcaatcgcacgggttccgccctgcctcccctgtacctggacagcgctacgttcgacgataccacccggcaacaactctgcgccgggttgggcctgcaagacacccaggattcgcttcaactactgatccctcccgaccagcctgcaacccgtacgatcgagacgatcagcaagatctatcggcaagcgagaatcgctcgcctgttcgggctatcggtcgtggaatgccgacaattggtgcaaatgctcgggaatgcgaactttctcatgcagttgcgcaacccaacgttacgcaacaaacccaagggcacgactgacttcctcgacatgctcatgcacctggaatgggcgagccgttggtttaaagaaaacggcagcagcctgacgctgctcagacgccagctattgctggatagccaggtccaggacccgatcatcaatcagctattgaaggagttcgccagctatgaccaagcgtctctttccaaagcgttgcaactgcttgatcttcctcagcaacccggtgacgaaaaagatcgtttacccgccgttgactgggagtccttggcctatgcggcgctgcaacggatgcgtcccaataacagcatcgagatggcgctcgatcaagtgctctcttccgttcaaatcagcacgatgcccgcacgtacgacaacgttgatcgaccgagcgaagcctaagttcaacacactgctgagcaatgcgcgggatgagttgtggactttatatctacgccttaaagaaatcacccaagccgtcctccatgcgccaaacaatgccaacggctatcaaaaatacgacaatgactaccatttcctgcgtttatacgcccccgctgctacgccgctgcaaacgctcagttatctgatactgcggttacctcacgccgccgatattctgcaactgcccctcagcccacaagcacttcaccagtttctggtcaatccgcactggctcgcgagtaagtacagggcgtcttcgctgctcgaactgaccccgtacaacctctacctcatgcagcagttcaaacattgcatacaccactgcggcctaacggaagagcagctgctcaactacttcgaacacgccaataccctgcccaacggcgctacgcaaaacaccagtgaagaaacgaacgagcgtctcgctcaacttttaggttggagtgccagtgaaatcgatgtcttcagcagccaactgaaacctccacgcattacctcaatgaaccgcctggactgggtgctgcgctgccgccaagccagcatcgacacaggcctgcctgccaacatgctgatcaaagccagcgaactgaaagccgactctgcattggctgactggaagagcgtcggtgaggcggtcacaagtgcgtatccataa

SEQ ID NO: 227 - DNA, 2796 bp, Pseudomonas Sp.
atgaatatgcaaaccgacagcagccccttgctcgccaagctgattgatcactcacgtcctcccgcccccggtcgggacgatttcaagaccgccctgcggcgcctcaacctcaactcggtattggacatcgtacgattgtccgaaagcgcctttgccgagcaactggcaacgtacaacgatgacgatgcacacacggtgtacctcaaggcccagagcgccgccgcgcaactggaaacgctatttcgcgaacagcaagtctcgtcccccccttcttcaccgcgcaataaacgcagtctcccccccgagaccagcgcaacctaccaggccttgttcaaggaaaagtgggaccagttctgctccagttcgtcgattgcagcggttgactcaccgactgcctacctgcgggcgctctatttgttcgcccaacagctcgaaggaaacacccaggacgcaaacgcgctcaagctgtcgcagcgacgcccggaactcaaagaccaggtgatcaaccaacatagcgtttcgagccaggttcccatgttgtcgatcgtcaaccagatcttgctcaaaaatatcgcgccggccaaagaagaagatacctataaggtgctgagtgaaacctggtatccgttttctctgccctatcatttgcaccatcagcaatgccaacagggcctgtcgggcgacaagccggcgttgggtgaggtgaactatcgcatcagtcgccaattgcctctggcgggagaaaccagcacttacgggcaggtcggcgaacagaacaacgaagtccagtgtcagttatcggggttgagccctcaacaacagacaatgctgaaagctaaatgggttaccgaaacagaggtggaaaaagaggaaaaggtgaaaaagttccatctccagttttacaactggacgatagatcagacaggaccagagaaactcactgactttctgaaccatacacaactggatgccgaccaacttcaggcgctgcttgcacaacagactcagtcaccacgccaatcgcctaactgcaagcaaaaccccggcctcacctacggtgcgtgctatatcaacggcacgaccacacccgctatcagcctggacaacgccaagctgacccacgttagccttgagcgcttcgacaggctgcaacgcatgattcgtctacagcgctggctcggcctgcctttcgcgcaattggacaccctgatagtcagcgccatgcgctgtgaaggccatcgcaacagcacgctgctgatcacccataacaccctccggtcgctgggggtcttttgctatttgagcaaacgctacacgttgcaagccgaagaatttgccgccctgcttcatcagttacccgtccatgcctcaggcgaccgcgtgtcattgttcgaccaggtgttcaatcgcacgggttccgccctgcctcccctgtatctggacagcgctacgttcgacggtaccacccggcaacagctctgcgcggggttgggcctgcaagacacccaggattcgcttcaactactgatcaaccccaacaaacctgcaacccgcacgatcgagacggtcagcgagatctatcggcaagcgagagtcgctcgcctgttcgggttatcggtcgtggaatgccgacagttggtgcaaatgctcgggaatgcgaactttctcatgcagctgcgcaacccaacgttacgcaacaaaccgaagggcacgactgacttcctcgacatgctcatgcacctggagtgggccagccgttggtttaaagaaaacggcagcagcctggcgctgctcagacgccagctattgctggatcgccaggtccaggacccgatcatcaatcagctattgaaggagttcgccagctatgaccaagcgtctctttccgaagcgttgcaccggtttgatcttcctcagcaacccgatgacgaaacagttcgtttacccgccgttgactgggaatccttggcctatgcggcgctgcaacggatgcgtcccaataacagcatcgagatggcgctcgatcaagtgctctcctccgttgaaatcagcactatgcctgtacgtacgacacatttgatcaaccaagcgaaacctacactcaacacactgctgagcaaggtgcgtgatgagttgtgggctttatatctacgccttaaagaaatcacccaaaccgtcctccatgagccaagcaataccaacggctatcaaaaatacgacaatgaccaccatttcctgcgtttatatgcccccgctgcttcgccgctgcaaacgctcagttatctgatactgcggttacctcacgccgccgatattctgcaactgcccctcagcccacaagcacttcaccagttcctggtcaatccgcactggctcgcgagcaagtacaagatgtcttcgttacttgaactcaccccgtacaacctctacctcatgcagcagttcaaacattgcctacaccactgcggcctgacggaagagcaactgctcgactacttcgaacacgccaataccttgcccaacggcgctacgcaaaacaccagtgaagaaacgaacgagcgtctcgctcaacttttaggttggaacgccagtgaaatcgacgtcttctgcgacaaactgagacctccacgcattacctcaatgatgcgcctggactgggtgctgcgctgccgccaagccagcatcgacacaggcctgcctgccaacatgctgatcaaagccagcgaactgaaagccgactctacatttgctgactggaagagcgtcggcgaggcgatcacaagtgcgtattcataa

SEQ ID NO: 228 - DNA, 2028 bp, Pseudomonas Sp.
atgcaaaccgacaacagcccgttgctcgctcaactgattgatcactcacgcccgcccgctcccggtcgggacgatttcaagaccgccctgcggcgcctcaacatccactcgatattggacatcgtacgtttgtccgaagaggcctttaccgagcaactgaaaaagtacaacgatgacgatgcccacacggtgtatctcaaggcccagaacgctgccacgcaactggaaaccttatttcgcgaacagcaagtctcgcctcccgcttcttcaccgcgcaataaacgcagtatcccccccaagaccagcgcaatctaccaggccttgttccaggaaaagtgggaccagttctgctccagttcgtctattgcagcggtcgattcgccgattgcctacctgcgggcgctctatttattcgccctgcagctggaagaaaacaccaaggacacccgcgcactcaagctgtcgcagcgacgcccggaactcaaagacctggtactcaaccaacatagcgtttcgggccaggctcccatgttgtcgatcgtcaaccagatcctgctcaaaaatatcgcgcaggccaaagaagaagatacctataaggtgctgagtgaaacctggtacccgttttctctgccctatcacttccaccatcagcaatgccaacagggcttgtcgggcgacaagccggcgctgggtgagttgaactatcgcatcagtcgccagttgccgctggcggaagaaaccagcagttacgggcaggtcggcgaacagaacaacgaggtccaatgtcagttatcggggttgagccctcaacaacagacactgctgaaaagtagctgggtaaccgaaacgggcgcgaaagcgttctatcacaactattacaactggaagtctgatctgatcggaccggcaaaactcactgattttctgagccacacacaactggatgccgaccagcttcaggcactgcttgcactacagactcagtcaccacgccaatcgcctaactgcaagcaaaaaaccagcctcagctacggtgcgtgctacatcaacggcacgaccacacccgctatcagcctggacaacgccaagctgaccaacatcagccttgagcgctttgacaggctgcaacgcatgattcgtctacagcgctggctcggcctgcctttcgcgcaattggacaccctgatagtcagcgccatgcgctgcgaaggcaatcgcaacaacacgctgctgatcacccataacaccctccgggcgctgggggtcttttgctatttgagcaaacgctacacattgcaagccgaagagtttgctgcctggcttcatcaattacccgttcatgcctcaggcgaccgcgtgtcattgttcgaccaggtatttaatcgcaccgggtctgccctgccgcccctgtatctggacagtgccaggttcgacgataccacccggcaacagctctgcgctgggttgggcctgcaagacacccaggattcgcttcaactactgatcaaccccaacaagcctgcaacccgtacgatcgagacagtcagcgagatctatcggcaagcaagaatcgctcgcctgtttggggtatcggtcgtggaatgccgacaactggtgcaaatgctcgggaatgcgaaccttctcatgcagttgcgcaacccaacgttacgcaacaaaccgaagggcatgactgactttctcgatgtgctcatgcaactggaatgggccagccgttggtttaaagaaaacggcagcagcctggcgttgctcagatgccagctattgctggatcgccaggtccaggacccggtcatcaatcagctattgaaggagttcgccctctatgaccaagcgtccctttccaaagcgttgcaaccgcttgatcttcctcagcaacccattgacgaaaaagatcgtttacccgccgttgactgggaagccttggcctattcggcgctgcaacagatgcgtcccaggagcaacatcgatacatacatctactacgttctgccttcacgtcactacagc

SEQ ID NO: 229 - DNA, 714 bp, unknown
  environmental sample
ttggtaaaaaaatgggaaagggctttagtttcatttcatgtaagaaaaccctttcatcggtttgaggtagaaacagtagggacaggttttttatttgaaaatgaaggagtggtgggtatatatacggcatctcatgtaattaaacaaattatggatgataaaacacgtactgtacgaattaatgattcattttatctattaagtaacgttaatgtcttttatgaagatacccaagactatgcaatagttgaattaccaaaggatgcaatgaatggacagcgtatagttgcttttcctctagcacagcgaaaagatcttaatcttactaagtcttttatgatttttggttatccagctaataaaaatgttttacgtttagggaaacagcatttgtttaatacattgaatatttttagaaatgattttaaatatgatactgaaacagaagatatattttttgagtttaataagaaggataaatatatttatgaacctgatagcagttttaaatcattacctgcactaaatgggatgagtggtagtcccatagtacaaataatggttaataagaacactgaagcattgactcttcgagttattggtatttttaaaatacataggcataataataaagaaaaatatcttataggtagtacctttactaattttgcagatgaaattaatatgatgatctcgttaggtgtattaacataa

SEQ ID NO: 230 - DNA, 1320 bp, Bacillus Sp.
atgaagagcaaaattatggcaggatttttaataacatcaattgttaccggggcgactattcctatcaatactctcgcgacgccaattgttcaggcagaaacaaaacaagataatatagatatttcctcggcattacgaaaaataggtgcacactccaagttaacacaaacctttatcgatggagctttagcaagtccgaatgtacaacttgaagaagttccatctttaaatacaactcaatttctaattaaacaagatatgaaagagtggtcatccgaactttatcctaaattaattctattaaattcaaaaagtaaaggatttgtaactaaatttaatagttattatccaacattaaaaggatttatagataatggggaagataaagaagggtttacagatagactggaagtccttcaagacatgaccataacaaaccaagaaagtgtgcaacgtcaaattaatgagttaacagatctaaaactacaggtagataagaagttgaaaaatcttgatactgatgtggcaaaaacacagagtgtccttaattcagagggaacaggaaaaatagataagttaaaaaatgaaatgctagatacaaaaaaatcaattcaaaatgatttacagcaaatagcgttattaccaggagctttaaatgaacaaggactaaaggtattccaagaaatttatagtctatcaaaagatatcattgaaccggctgctcaaacagcagtagtagcgtataacaaaggaaaagaaataaacaatgctattgtagacgcagagaataaagcagagcaagaagcaaaagaaaaaggaaaatcagctatagaaattgaggctgccaaaaaagaagcacgtgaagcgatagagaaaagtaaaaaaggtgaaatcgctgcagctgcagttacaaaaacgaaagagtatgatcttatgaaagtaattgatcctgaaaaaattaaaaaaacatataatacttttgctgaaattaataaactaacagcagagcaacgtgcatatttaaatgatttagagaaacaaaatcagaaattatatgacttaacgactaaattaacagtagcagatttacaaaaatcaatgattcttttcatgcaaaatgatttgcatacatttgctaaccaagtagatgtagaaattgagctaatgaaacgttacaaagaggatttggatctaataaataatagtattacaaaattatcgactgaagttgataccaataacacccagtctcaaaaagatacattaagacgattaaaaagtgtaacaactcaactcgaagaacaagtttataaattttaa

SEQ ID NO: 231 - DNA, 1320 bp, Bacillus Sp.
atgaagaataaaattatgacaggatttttaataacatcaatcgttactggagcgactattcctatcaatactctcgcaacgccaatcgttcaggcagaaacaaaacaagaaaatatagatatttcctcagcattacgaaaaataggtgcacactccaaattaacacaaacctttatcgatggagccttatcaagtccgaatgtacaacttgaagaagttccatctttaaatacaactcaatttctaattaaacaagatatgaaagagtggtcatccgaactttatcctaaattaattctattaaattcaaaaagtaaaggatttgtaactaaatttaatagttattatccaacattaaaaggatttgtagataataaggaagataaagaagggtttacagatagactggaagtccttcaagacatgaccatcacaaaccaagaaagtgtgcaacgtcaaattaatgagttaacagatctaaaactacaggtagataagaagttgaaaaatcttgatactgatgtggcaaaaacacagagtgtccttaattcagagggaacaggaaaaatagataagttaaaaaatgaaatgctagatacaaaaaaatcaattcaaaatgatttacagcaaatagcgttattaccaggagctttaaatgaacaaggactaaaggtattccaagaaatttatagtctatcaaaagatatcattgaaccggctgctcaaacagcagtagtagcgtataacaaaggaaaagaaataaacaatgctattgtagacgcagagaataaagcagagcaagaagcaaaagaaaaaggaaaatcagctatagaaattgaggctgccaaaaaagaagcacgtgaagcgatagagaaaagtaaaaaaggtgaaatcgctgcagctgcagttacaaaaacgaaagagtatgatcttatgaaagtaattgatcctgaaaaaattaaaaaaacatataatacttttgctgaaattaataaactaacagcagagcaacgtgcatatttaaatgatttagagaaacaaaatcagaaattatatgacttaacgactaaattaacagtagcagatttacaaaaatcaatgattcttttcatgcaaaatgatttgcatacatttgctaaccaagtagatggagaaattgagctaatgaaacgttacaaagaggatttggatctaataaataatagtattacaaaattatcgactgaagttgataccaataacacccagtctcaaaaagatacattaagacgattaaaaagtgtaacaactcaactcgaagaacaagtttataaattttaa

SEQ ID NO: 232 - DNA, 1320 bp, Bacillus Sp.
atgaagaataaaattatgacaggatttttaataacatcaattgttaccggggcgacttttcctatcaatactctagcaacgccaatcgttcaggcagaaacaaaacaagataatgtagatatttcctcagcattacgaaaaataggtgcacactccaagttaacacaaacctttatcgatggagctttagcaagtccgaacgtacaatttgaagaaattccatctttaaatacaactcaatttctaattaaacaagatatgaaagagtggtcatccgaactttaccctaaattaattctattaaattcaaaaagtaaaggatttataactaaatttaatagttattatccaacattaaaaggatttgtagataataaggaagataaagaagggtttacagatagactggaagttcttcaagacatgactataacaaatcaagaaagtgtgcaacgtcaaattaatgagttaacagatttaaaattactggtagataagaagttgaaaaaccttgatactgatgtggtaaaagcacaaagtgtccttaattcagagggaacaggaaaaatagataagttaaaaaatgaaatgctagatacaaaaaaatctattcaaaatgatttgcagcaaatagcattattaccaggcgcgttaaatgaacaagggctaaaggtattccaagaaatttatagtctatcgaaagatatcattgaaccggctgctcaaacagcagtagtagcgtataacaaaggaaaagaaataaacaatgccattgtagacgcagagaagaaagcagagcaagaagcaaaagaaaagggaaaatcagctatagaaattgaagctgccaaaaaagaagcacgtgaaacgatagagaaaagtaaaaaaggtgaaatcgctgcagctgcagttacaaaaacgaaagagtatgatcttatgaaagtgattgatcctgaaaaaataaaaaaaacatataatacttttgctgaaattaataaactaacagctgagcaaagagcatatttaaatgatttagagaaacaaaatcagaaattatatgacttaacaactaaattaacagtagcagatttacaaaaatcaatgattcttttcatgcaaaatgacttgcatacatttactaatcaagtagatggagaaattgagttaatgaaacgttacaaagaggatttggatctaataaataatagtattacaaaattatcgactgaagttgataccaataatactcaggctcaaaaagatatattaagacgattaaaaagtgtaacaattcaacttgaagaacaagtttataaattttga

SEQ ID NO: 233 - DNA, 1320 bp, Bacillus Sp.
atgaagaataaaattatggcaggatttttaataacatcaatggtttctggtgctactattcctatcaatacactcgcaatgccaatcgttcgggcagaaatgaaacaagataatatagatatttcctcagcattaagaaaaataggtgcacactccaaattaacacaaacctttatagatggagccttagcaagtccgaatgtacaacttgaagaagttccatctttaaatacaaatcaatttctaattaaacaagatatgaaagagtggtcatccgaactttatccaaaatttattctattaaattcaaaaagtaaaggatttgtaactaaatttaatagttattatccaacattaaaagggtttgtagataataaggaagataaagatgggtttacagatagactggaagtccttcaagacatgaccataacaaaccaagaaagtgtgcaacgtcaaattaatgagttaatagatctaaaactacaggtaaataaaaagttgaaaaatcttgattccgatgtgataaaagcacagagtatccttagttcagagggaacaggaaaaatagataagttaaaaacagaaatgctagatacaaaaaaatcaattcaaaatgatttacagcaaatagcattattaccaggagccttaaatgaacaagggctaaaggtattccaagaaatttatagtctatcgaaagatatcattgaaccggctgctcaaacagcagtagtagcgtataacaaaggaaaagaaataaacaatgctattgtagacgcagagaagaaagcagagcaagaagcaaaagaaaagggaaaatcagctatagaaattgaggctgccaaaaaagaagcacgtgaagcaatagagagaagtaaaaaaggtgaaattgctgcagctgcagttacaaaaacgaaagagtatgatcttatgaaagtgattgatcctgaaaaaataaaaaaaacatataatacttttgctgaaattaataaactaacagcagagcaacgtgcatatttaaatgatttagagaaacaaaatcagaaattatatgacttaacaactaaattaactgtagtggatttacaaaaatcaatgattcttttcatgcaaaatgatttgcatacatttgctaaccaagtagatggagaaattgagctaatgaaacgttacaaagaggatttggatctaataaataatagtattacaaaattatcgactgaagttgatgccaataacactcagtctcaaaaagatacattaagacgattaaaaagtgtaacaactcaactcgaagaacaagtttataaattctaa

SEQ ID NO: 234 - DNA, 1320 bp, Bacillus Sp.
atgaagaataaaattatgacaggatttttaataacatcaatcgttactggagcgactattcctatgaatactctcgcaacgccaaccgttcaggcagaaacaaaacaagaaaatatagatatatcctcagcattacgaaaaataggtgcacactccaaattaacacaaacctttatagatggagccttagcaaatccgaatgtgcaacttgaagaagttccatctttaaatacaactcaatttctaattaaacaagatatgaaagagtggtcatcagaactatatccaaaattaattctactaaattcaaaaagtaaaggatttgcaaccaaatttaatagctattatccaacattaaaaggatttgtagataataaggaagataaagaagggtttttagatagactggaagttcttcaagatatgactataacaaaccaagaaaacgtgcaacgtcagattaatgagttaacagatcttaaactacaggtagataagaaactgaaaaatcttgatacagatgtggtaaaagcacaaagtgtacttagtttagagggaacaggaaaaatagacaaattaaaaaatgaaatgctaaatacaaaaaaatcaattcaaaatgatttacagcaaatagcattattaccaggagctttaaatgaacaagggctaaaggtattccaagaaatttatagtctatcaaaagatatcattgaaccggctgctcaaaccgcagtagtggcgtataacaaaggaaaagaaataaacaatgctattgtagaagcagagaagaaagcagagcaggaagcaacagaaaagggaaaatcagctatagaaattgaagctgcaaaaaaagaagcacgtgaagcgatagagaaaagtaaaaaaggtgaaattgctgcagctgcagttacaaaaacgaaagagtatgatcttatgaaagtgattgatcccgaaaaaattaaaaaaacatatagtacctttgccgaaattaataaactaacagcagagcaaagagcatatttaaatgatttagagaaacaaaatcagaaattatatgaattaacaactaaattaacagtagcagatttacaaaaatcaatgattcttttcatgcaaaatgatttgcatacatttgctaatcaagtagatggggaaattgagctaatgaaacgttataaagaggatttgaatttaataagtaatagtattacaaaattatcgactgaagttgatactaataacactcagtctcaaaaagatacattaagacgactaaaaaatgtaacaaatcaactcgaagaacaagtttataaattttaa

SEQ ID NO: 235 - DNA, 1341 bp, Bacillus Sp.
atgaagaataaaattatgacaggatttttaataacatcaattgttaccggggcgacttttcctatcaatactctagcaacgccaatcgttcaggcagaaacaaaacaagataatgtagatatttcctcagcattacgaaaaataggtgcacactccaagttaacacaaacctttatcgatggagctttagcaagtccgaacgtacaatttgaagaagttccatctttaaatacaactcaatttctaattaaacaagatatgaaagagtggtcatccgaactttatcctaaattaattctattaaattcaaaaagtaaaggatttgtaactaaatttaatagttattatccaacattaaaaggatttgtagataataaggaagataaagaagggtttacagatagactggaagtccttcaagacatgaccatcacaaaccaagaaagtgtgcaacgtcaaattaatgagttaacagatttaaaattactggtagataagaagttgaaaaaccttgatactgatgtggtaaaagcacaaagtgtccttaattcagagggaacaggaaaaatagataagttaaaaaatgaaatgctagatacaaaaaaatctattcaaaatgatttgcagcaaatagcattattaccaggcgcgttaaatgaacaagggctaaaggtattccaagaaatttatagtctatcgaaagatatcattgaaccggctgctcaaacagcagtagtagcgtataacaaaggaaaagaaataaacaatgccattgtagacgcagagaagaaagcagagcaagaagcaaaagaaaagggaaaatcagctatagaaattgaagctgccaaaaaagaagcacgtgaaacgatagagaaaagtaaaaaaggtgaaatcgctgcagctgcagttacaaaaacgaaagagtatgatcttatgaaagtgattgatcctgaaaaaataaaaaaaacatataatacttttgctgaaattaataaactaacagctgagcaaagagcatatttaaatgatttagagaaacaaaatcagaaattatatgacttaacaactaaattaacagtagcagatttacaaaaatcaatgattcttttcatgcaaaatgacttgcatacatttactaatcaagtagatggagaaattgagttaatgaaacgttacaaagaggatttggatctaataaataatagtattacaaaattatcgactgaagttgataccaataacacccagtctcaaaaagatacattaagacgattaagactattcctatcaatactctcgcaacgccaatcgttcaggcagaaacaaaacaagaaaatatag

SEQ ID NO: 236 - DNA, 1320 bp, Bacillus Sp.
atgaagaataaaattatgacaggatttttaataacatcaatcgttactggagcgactattcctatcaatactctcgcaatgccaattgttcaggcagaaacggagcaagatagtatagatatttcctcatcattacgaaaaataggtgcacactccaagttaacacagacttttatagatggagctttagcaagtccgaatgtgcaacttgaagaagttccatctttaaatacaactcaatttctaattaaacaagatatgaaagagtggtcatcagaactatatccaaaattaattctactaaattcaaaaagtaaaggatttgcaaccaaatttaatagctattatccaacattaaaaggatttgtagataataaggaagataaagaagggtttatagatagactggaagttcttcaagatatgactataacaaaccaagaaaacgtgcaacgtcagattaatgagttaacagatcttaaactacaggtagataagaaactgaaaaatcttgatacagatgtggtaaaagcacagagtatacttagctcagagggaacaggaaaaatagacaagttaaaaaatgaaatgctaaatacaaaaaaatcaattcaaaatgatttacaacaaatagcattattaccaggagctttaaatgaacaagggctaaaggtattccaagaaatttatagtttatcaaaagatatcattgaaccggctgcccaaacagcggtagcagcgtataacaaaggaaaagaaattaacaacgctattgtagaagcagagaaaaaagcagagcaagaagcaacagaaaagggaaaatcagccttagaaattgaagttgccaaaaaagaagcacgtgaagcgatagagaacaataaaaaaggtgaaattgcagcagctgcagttacaaaaacaaaagagtatgatcttatgaaagtaattgatcctgaaaaaatcaaaaaaacatatagtacctttgctgaaattaataaactaacagcagagcaacgagcgtatttagatgatctagagaaacaaaatcaaaagttatatgatttaacaacaaaattaacagtagcagatttacaaaaatcaatgattcttttcatgcaaaatgatttgcatacatttgctaaccaagttgatggagaaattgatctaatgaaacgctataaagatgatttgaatctaataaataatagtattacaaaactatcgactgaagttgatactgttaacaatcagtctcaaaaagatacattaagacgactaaaaaatgtaacgagccaactcgaagaacaggttaataaattttga

SEQ ID NO: 237 - DNA, 1241 bp, Bacillus Sp.
atgaagaataaaattatgacaggatttttaataacatcaattgttaccggggcgacttttcctatcaatactctagcaacgccaatcgttcaggcagaaacaaaacaagataatgtagatatttcctcagcattacgaaaaataggtgcacactccaagttaacacaaacctttatcgatggagctttagcaagtccgaacgtacaatttgaagaaattccatctttaaatacaactcaatttctaattaaacaagatatgaaagagtggtcatccgaactttaccctaaattaattctattaaattcaaaaagtaaaggatttataactaaatttaatagttattatccaacattaaaaggatttgtagataataaggaagataaagaagggtttacagatagactggaagttcttcaagacatgactataacaaatcaagaaagtgtgcaacgtcaaattaatgagttaacagatttaaaattactggtagataagaagttgaaaaaccttgatactgatgtggtaaaagcacaaagtgtccttaattcagagggaacaggaaaaatagataagttaaaaaatgaaatgctagatacaaaaaaatctattcaaaatgatttgcagcaaatagcattattaccaggcgcgttaaatgaacaagggctaaaggtattccaagaaatttatagtctatcgaaagatatcattgaaccggctgctcaaacagcagtagtagcgtataacaaaggaaaagaaataaacaatgccattgtagacgcagagaagaaagcagagcaagaagcaaaagaaaagggaaaatcagctatagaaattgaagctgccaaaaaagaagcacgtgaaacgatagagaaaagtaaaaaaggtgaaatcgctgcagctgcagttacaaaaacgaaagagtatgatcttatgaaagtgattgatcctgaaaaaataaaaaaaacatataatacttttgctgaaattaataaactaacagctgagcaaagagcatatttaaatgatttagagaaacaaaatcagaaattatatgacttaacaactaaattaacagtagcagatttacaaaaatcaatgattcttttcatgcaaaatgacttgcatacatttactaatcaagtagatggagaaattgagttaatgaaacgttacaaagaggatttggatctaataaataatagtattacaaaattatcgactgaagttgataccaataa

SEQ ID NO: 238 - DNA, 1425 bp, Bacillus Sp.
ttggaaaaaattctattttcaagtgtgtatgaagaaattctaacgttagattttacagcatatacgattaaaatcgtaaaaaataatagtaaagaggtgtacggaatgaagggcaaaattatggcaggatttttaataacatcaattgttaccggggcgactattcctatcaatactctcgcaacgccaattgttcaggcagaaacaaaacaagataatatagatatttcctcagcattacgaaaattaggtgcacactccaagttaacacaaacctttattgatggagctttagcaaatccgaatgtacaacttgaagaagttccatctttaaatacaactcaatttctaattaaacaagatatgaaagagtggtcatcggaactttatcctaaattaattctattaaattcaaaaagtaaaggatttgtaactaaatttaatagttattatccaacattaaaaggatttgtagataataaggaagataaagaagggtttacagatagactggaagtccttcaagacatgaccatcacaaaccaagaaagtgtgcaacgtcaaattaatgagttaacagatctaaaactacaggtagataagaagttgaaaaatcttgatactgatgtggcaaaaacacagagtgtccttaactcagagggaacaggaaaaatagataagttaaaaaatgaaatgctagatacaaaaaaatcaattcaaaatgatttacagcaaatagcgttattaccaggagctttaaatgaacaaggactaaaggtattccaagaaatttatagtctatcaaaagatatcattgaaccggctgctcaaacagcagtagtagcgtataacaaaggaaaagaaataaacaatgctattgtagacgcagagaataaagcagagcaagaagcaaaagaaaaaggaaaatcagctatagaaattgaggctgccaaaaaagaagcacgtgaagcgatagagaaaagtaaaaaaggtgaaatcgctgcagctgcagttacaaaaacgaaagagtatgatcttatgaaagtaattgatcctgaaaaaattaaaaaaacatataatacttttgctgaaattaataaactaacagcagagcaacgtgcatatttaaatgatttagagaaacaaaatcagaaattatatgacttaacgactaaattaacagtagcagatttacaaaaatcaatgattcttttcatgcaaaatgatttgcatacatttgctaaccaagtagatggagaaattgagctaatgaaacgttacaaagaggatttggatctaataaataatagtattacaaaattatcgactgaagttgataccaataacacccagtctcaaaaagatacattaagacgattaaaaagtgtaacaactcaacttgaagaacaagtttataaattttaa

SEQ ID NO: 239 - DNA, 1401 bp, Bacillus Sp.
atgtgtgaagaaatcctaacgttatgttgtacaacatttacgattaaaactgtaaaaaacaatagtgaagaggtgtacggaatgaagaataaaattatgacaggatttttaataacatcaatcgttactggagcgactattcctatcaatactctcgcaacgccaaccgttcaggcagaaacgaaacaagaaaatatagatatttcctcagcattacgaaaaataggtgcacactccaaattaacacaaaccgttatagatggagccttagcaaatccgaatgtgcaacttgaagaagttccatctttaaatacaactcaatttctaattaaacaagatatgaaagagtggtcatcagaactatatccaaaattaattctactaaattcaaaaagtaaaggatttgcaaccaaatttaatagctattatccaacattaaaaggatttgtagataataaggaagataaagaagggtttttagatagactggaagttcttcaagatatgactataacaaaccaagaaaacgtgcaacgtcagattaatgagttaacagatcttaaactacaggtagataagaaactgaaaaatcttgatacagatgtggtaaaagcacaaagtgtacttagttcagagggaacaggaaaaatagacaaattaaaaaatgaaatgctaaataccaaaaaatcaattcaaaatgatttacagcaaatagcattattaccaggagctttaaatgaacaagggctaaaggtattccaagaaatttatagtctatcaaaagatatcattgaaccggctgctcaaaccgcagtagtggcgtataacaaaggaaaagaaataaacaatgctattgtagaagcagagaagaaagcagagcaggaagcaacagaaaagggaaaatcagctatagaaattgaagctgcaaaaaaagaagcacgtgaagcgatagagaaaagtaaaaaaggtgaaattgctgcagctgcagttacaaaaacgaaagagtatgatcttatgaaagtgattgatcccgaaaaaattaaaaaaacatatagtacctttgccgaaattaataaactaacagcagagcaaagagcatatttaaatgatttagagaaacaaaatcagaaattatatgaattaacaactaaattaacagtagcagatttacaaaaatcaatgattcttttcatgcaaaatgatttgcatacatttgctaatcaagtagatggggaaattgagctaatgaaacgttataaagaggatttgaatttaataagtaatagtattacaaaattatcgactgaagttgatactaataacactcagtctcaaaaagatacattaagacgactaaaaaatgtaacaaatcaactcgaagaacaagtttataaattttaa

SEQ ID NO: 240 - DNA, 1401 bp, Bacillus Sp.
atgtgtgaagaaatcctaacgttatgttgtacaacatttacgattaaaactgtaaaaaacaatagtgaagaggtgtacggaatgaagaataaaattatgacaggatttttaataacatcaatcgttactggagcgactattcctatgaatactctcgcaacgccaaccgttcaggcagaaacgaaacaagaaaatatagatatatcctcagcattacgaaaaataggtgcacactccaaattaacacaaacctttatagatggagccttagcaaatccgaatgtgcaacttgaagaagttccatctttaaatacaactcaatttctaattaaacaagatatgaaagagtggtcatcagaactatatccaaaattaattctactaaattcaaaaagtaaaggatttgcaaccaaatttaatagctattatccaacattaaaaggatttgtagataataaggaagataaagaagggtttttagatagactggaagttcttcaagatatgactataacaaaccaagaaaacgtgcaacgtcagattaatgagttaacagatcttaaactacaggtagataagaaactgaaaaatcttgatacagatgtggtaaaagcacaaagtgtacttagtttagagggaacaggaaaaatagacaaattaaaaaatgaaatgctaaatacaaaaaaatcaattcaaaatgatttacagcaaatagcattattaccaggagctttaaatgaacaagggctaaaggtattccaagaaatttatagtctatcaaaagatatcattgaaccggctgctcaaaccgcagtagtggcgtataacaaaggaaaagaaataaacaatgctattgtagaagcagagaagaaagcagagcaagaagcaacagaaaagggaaaatcagttatagaaattgaagctgccaaaaaagaagcacgtgaagcgatagagaaaagtaaaaaaggtgaaattgctgcagctgcggttacaaaaacgaaagagtatgatcttatgaaagtgattgatcctgaaaaaattaaaaaaacatatagtacctttgccgaaattaataaactaacagcagagcaaaaagcatatttaaatgatttagagaaacaaaatcagacattatatgacttaacaactaaattaacagtagcagatttacaaaaatcaatgattcttttcatgcaaaatgatttgcatacatttgctaatcaagtagatggagaaattgagctaatgaaacgttataaagaggatttaaatttaataaataatagtattacaaaattaacgactgaagttgatactaataacactcagtctcaaaaagatacattaagacgactaaaaaatgtaacaattcaactcgaaggacaggttaataaattttaa

SEQ ID NO: 241 - DNA, 1425 bp, Bacillus Sp.
ttggaaaaatctttatcctcaagtatatgtgaagaaatcctaacgttaggttgtacaacatttacgattaaaactgtaaaagacaatagtgaagaggtgtacggaatgaagaataaaattatgacaggatttttaataacatcaatcgttactggagcgactattcctatcaatactctcgcaacgccaatcgttcaggcagaaatgaaacaagaaaatatagatatttcctcagcattacgaaaaataggtgcacactccaaattaacacaaacctttatagatggagccttagcaagtccgaatgtgcaacttgaagaagttccatctttaaatacaactcaatttctaattaaacaagatatgaaagagtggtcatcagaactatatccaaaattaattctactaaattcaaaaagtaaaggatttgcaaccaaatttaatagctattatccaacattaaaaggatttgtagataataaggaagataaagaagggtttatagatagactggaagttctccaagatatgactataacaaaccaagaaaacgtgcaacgtcagattaatgagttaacagatcttaaactacaggtagataagaaactgaaaaatcttgatacagatgtggtaaaagcacagagtgtacttagttcagagggaacaggaaaaatagacaagttaaaaaatgaaatgctaaatacaaaaaaatcaattcaaaatgatttagagcaaatagcattattaccaggagctttaaatgaacaagggctaaaggtattccaagaaatttatagcctatcaaaagatatcattgaaccggctgctcaaacagcggtagtagcgtataacaaaggaaaagaaataaataatactattgtagaagcagagaagaaagcagagcaggaagcaacagaaaagggaaaatcagctatagaaattgaagctgcaaaaaaagaagcacgtgaagcgatagagaaaagtaaaaaaggtgagattgctgcagctgcagttacaaaaacgaaagagtatgatcttatgaaagtgattgatcctgaaaaaattaaaaaaacatatagtacctttgccgaaattaataaactaacagcagagcaaagagtatatttaaatgatttagagaaacaaaatcagaaattatatgacttaacaactaaattaacagtagcagatttacaaaaatcaatgattcttttcatgcaaaatgatttgcatacatttgctaatcaagtagatggagaaattgagctaatgaaacgttataaagaggatttgaatctaataaataatagtattacaaaattagtgactgaagttgatactagtaacactcagtctcaaaaagatacattaagacgactaaaaaatgtaacaaatcaactcgaagaacaagtttataaattttaa

SEQ ID NO: 242 - DNA, 1320 bp, Bacillus Sp.
atgaaaaataaaataattacaggatttttaataacatcaattgttactggggcgaatattcctatcaatactcttgcaatgccaatcgttcaggcagaaactcaacaagagaatacggatatttcctcatccttacgaaaattaggtgcacaatctaaattaatccaaacatatattgatcaagctttaatgagtcctaatgtacagcttgaggaagtcccagctttaaatacgaaccaatccctgatcaaacaagatatgaacgaatggtcatcagaactttatccaaaattaattctattaaattcaaaaagtaaaggatttgtaacccaatttaatagctattatccaacattaaaacagtttgtagacaataatgaagataaagaagggttcttggatagacttgaagttcttcaagataaaactacgacaaaccaagaaagcgtacaacgtcagattaatgaattaactgatattaaattacagattgataaaaaacttaaagatctcgatactgacgtgacaaaagcacaaggtgtactaagttcagagggaacagggaaaatagaccagctaaaaaatgaattgctaaatacccaaaaatcaattcaaagtgatttacaacaaatagcattgttaccaggagctttaaatgaacaaggacttaagatattccaagaaatctatagtctttcaaaagatatcattgaaccggctgctcaaacagcggtggcagcgtataacaaaggaaaagaaattaacaactctattttagaagcagagaaaaaagcagagcaagaagcgaaagaaaaaggtaaatctgctctagagattgaagctgccaaaaaagaagctcgtgaagcaattgagaaaagcaaacaagctgaaatagctgcagctgcaattacaaagacaaaagagtatgaccttacgaaggttattgaccctgaaaaaattaaaaaaacttatagtgccttcgctgaagtaaataaacttacaacagagcagcgagcacatttagatgatttagagaaacaaaaccaaaaattatatgatttaacaaagagcctaacagtagcagatttacaaaagtctatgcttcttattatgcaaaatgatttacatacatttgcaaatcaagtagatgtagaacttgacctattaaaacgctataaagaagatatggatctaattaaaaataatattacaaaattatctactaatgttgatacaactgatcagcagtctcaaaaagatacattaagacaattaaaaaatgtaacaagttaccttgaagaacaagttaataagttttaa

SEQ ID NO: 243 - DNA, 1320 bp, Bacillus Sp.
atgaaaaataaaataattaaaggatttttaataacatccattgttactggggcagctattcctatcaatactctcgcaacgccaatcgttaaggcagaaacgcaacaagagaacacggatatttcctcatcattacgaaaattaggtgcgcaatctaaattaatccaaacatatatagatcaagctttaatgagtcctaatgtacagctagaggaagttccatctttaaatacgaaccaatccctaatcaagaaagatatgacagaatggtcatcggaactttatccaaaattaattctattaaattcaaaaagtaaaggatttgtaactcaatttaatagctattacccaacattaaaacagtttgtagacaataaagaagataaagaagggttcttggatagacttgaagttcttcaagataaagctatgacaaaccaagaaaacgtacaacgtcagattaatgaattaacagatcttaaattacagcttgataataaacttaaagatctcgatactgatgtgacaaaagcacagggtgcactaagttcagagggaacagggaaaatagaccagctaaaaaatgaattacaagatacccaaaaatcaattcaaaatgatttacaacaaatagcattgttaccgggagctttaaatgaacaaggacttactatattcaaagaagtctataatctttcaaaagatatcattgaaccggctgcccaaacagcggtggcagcgtataacaaaggaaaagaaattaacaaatctattttagaagcagagaaaaaagcagagcaagaagcgaaagaaaaaggtaaatctgctttagagattgaagctgccaaaaaagaagctcgtgaagcaattgagaaaagcaaacaagctgaaatagctgcagctgcagttacaaagacaaaagagtatgaccttacgaaagttattgaccctgaaaaaattaaaaaaacatatagtgccttcgctgaagtaaataaactaacagcagaacagcgagcacatttagcagatttagagacacaaaaccaaaaattttatgatttaacaaagaacctaacagtagcagatttacaaaaatctatgcttcttattatgcaaaatgatttacatacatttgcaaatcaagtagatgtagaacttgacctattaaaacgctataaagaagatttgggtctaatcaaaaatagtattacaaaattatctactaatgttgatacaactgaccagcagtctcaaaaggatacattaagacaattaaaaaatgtaacaagttaccttgaagaacaagtttataagttttaa

SEQ ID NO: 244 - DNA, 1320 bp, Bacillus Sp.
atgaaaaataaaatacttacagggtttttaataacatccattgttagtggggcgaatattcctataaatactctcgcaacgccaatcgtccaggcagaaacgcaacaggaaaatatggatatttcctcatcattacgaaaattaggtgcacaatctaaattaatccaaacatatatagataaagctttaatgagtcctaatgtacagctagaggaagttccatctttaaatacgaaccaatccctgatcaaacaagatatgaacgaatggtcatcagaactttatccaaaattaattctattaaattcaaaaagtaaaggatttgtaaaccaattcaatagctattatccaacattaaaacagtttgtagacaataaagaagataaagaagggttcttggatagacttgaagttcttcaagataaagctacgataaaccaagaaagtgtacaacgtcagattaatgaattaacagatcttaaattacagattgataaaaagcttaaagatctcgatactgacgtgacaaaagcacagggtgtactaaattcagagggaacagggaaaatagaccagctaaaaaatgaattgctaaatacccaaaaatcaattcaaagtgatttacaacaaatagcactgttaccaggagctttaaatgaacaaggatttaagatattccaagaaatttatagtctttcaaaagatatcattgaaccggctgctcaaacagcagtggcagcgtataacaaaggaaaagaaattaacagctctattttagaagcagagaaaaaagcagagaaagaagcgaaagaaaaaggaaaatctgctctagagattgaagctgcaaaaaatgaagcccgtgaagcaattgagaaaagcaaacaagctgaaatagctgcagctgcaattacaaagacaaaagagtatgaccttacgaaggttattgaccctgaaaaaattaaaaaaacttatagtgccttcgctgaagtaaataaactaacaacagagcagcgagcacatttagatgatttagagaaacaaaaccaaaaattttatgatttaacaaagaacctaacagtagcagatttacaaaagtctatgattcttattatgcaaaatgatttacatacatttgcaaatcaagtagatgtagaacttgacctattaaaacgctataaagaagatatgaatctaattaaaaataatattacaaaattgtctactaatgttgatacaactgatcggcagtctcaaaaagatacattaagacaattaaataatgcaacaatttaccttgaagaacaagttaataagttttaa

SEQ ID NO: 245 - DNA, 1320 bp, Bacillus Sp.
atgaaaaataaaataattacaggactttttataacatcaattgtaactggggcgactattcctatcaatactcttgcaacaccaatcgttcatgcagaaactcaacaggaaagcatggatatatcctcatcattacgaaaattaggtgcacaatctaaattaatccaaacatatattgatcaaggtttaatgagccctaatgtacagctagcagaagtcccagctttaaatacaaatcaatccctaatcaagcaagatatgaaggaatggtcatcagaactttatccaaatttaattctagtaaattcaaaaagtaaagggtttgtaactaaatttaatagctattatccaacattaaaagcgtttgtagacaataaagaagataaagaaggctttgtggatagacttgaagttcttcaagatatgactatgacgaaccaagaaaacgtacaaagacagattaatgaattaacagatcttaaattacagctggataaaaaacttcaagatctcgatatggatgtaacaaaagcacagggtgtactaagttcagatggaacagggaaaatagatcagctaaaaaatgaattacaaaatacccaaaaatcaattcaaaatgatttacaacaaatagcattattaccaggagctttaaacgaacaaggatttgttatattcaaagaagtctataacctttcaaaagatatcattgaaccggctgctcaaacagcggtagcagcgtataacaaaggaaaagaaattaacaactctattttagaagcagagaaaaaagcagaacaagaagcgaaagaaaagggtaaatctgctctagagattgaagcggccaaaaaagaagcccgtgaagcaattgagaaaagcaaacaagctgaaatagctgcagctgcagttacaaaaacaaaagagtatgaccttacgaaagtaattgatcctgaaaaaattaaaaaaacatatagtgctttcgctgaagtaaataaactaacagcagaacagcgaacacatttagcagatttagagacacaaaaccaaaaattttatgatttaactaagaacctaaaaatagcagatttacaaaaatcaatgcttcttattatgcaaaatgatttacatacatttgcaaatcaagtagatgtagaacttgacctactaaagcgctataaggaagatttgggtgtaataaaaaatagcattacaaaattatctactaatgttgatataactaaccagcagtctcaaaaagatacattaagacaattaaaaaatgtaataagttatcttgaagagcaggtctataaattttaa

SEQ ID NO: 246 - DNA, 1320 bp, Bacillus Sp.
atgaaaactaaaataatgacaggatttttaataacatccattgtaactggagcaactattcctatcaatactctcgcaacaccaatcgttcaagcagaaactcaacaagaaaacatggatatttcttcatcattacgaaaattaggtgcgcattctaaattagtccaaacgtatattgatcaatctttaatgagtcctaatgtacagctagaggaagtcccagctttaaataccaatcaattcctaatcaaacaagatatgaaggaatggtcatcggaactctatccacagttaattctattaaattcaaaaagtaaaggatttgtaacaaaatttaatagttattacccgacattaaaatcgtttgtagacaataaagaagatagagaagggttttcggatagacttgaagtacttcaagaaatggctatgacgaatcaagaaaatgcgcaacgacaaatcaatgaattaacagatcttaaattacagcttgataaaaaattaaaagattttgatactaatgtggcaactgcgcaaggcatactaagtacagatggaacaggaaaaatagatcagttaaaaaatgaaatattaaataccaaaaaagcaattcaaaatgatttacagcaaattgcattaataccaggggctttaaatgaacagggatttgctatattcaaagaagtttatagtctttcaaaagaaattattgaaccggctgctcaagcaggggtggcagcgtataacaaaggaaaagaaattaacaactctattttagaagcggagaaaaaagcggcgcaagaagcgacagaacaaggtaaaactgctctagagattgaagcagcaaaaaaagcagctcgtgaagcaattgagaaaagcaaacaaggtgaaatagcagccgcagccgcagcaaaaacacaagagtatgacctgatgaaggtcattgataccgaaaagattaagaaaacatttggcgtttttgctgaagtaaataaattaacagcagaacagcgagcatatttagatgatttagagaaacaaaatcaaaaaatatatgatttaacaacgaaattatcaatagctgatttacaaaaatcaatgcttcttcttacacaaaatgatttgcatacgtttgcaaatcaagtagatgtagaacttgatctactaaagcgctataaagaagatttaaatctaataaaaaatagcattacaaaattatctactaatgttgatacaactaacgagcagtctcaaaaagatacattaagacaattaaaaaatgtaataagttaccttgaagaacaagtatataaattttaa

SEQ ID NO: 247 - DNA, 1305 bp, Bacillus Sp.
atgacaggatttttaataacatccattgtaactggagcaactattcctatcaatactctcgcaacaccaatcgttcaagcagaaactcaacaagaaaacatggatatttcttcatcattacgaaaattaggtgcgcattctaaattagtccaaacgtatattgatcaatctttaatgagtcctaatgtacagctagaggaagtcccagctttaaataccaatcaattcctaatcaaacaagatatgaaggaatggtcatcggaactctatccacagttaattctattaaattcaaaaagtaaaggatttgtaacaaaatttaatagttattacccgacattaaaatcgtttgtagacaataaagaagatagagaagggttttcggatagacttgaagtacttcaagaaatggctatgacgaatcaagaaaatgcgcaacgacaaatcaatgaattaacagatcttaaattacagcttgataaaaaattaaaagattttgatactaatgtggcaactgcgcaaggcatactaagtacagatggaacaggaaaaatagatcagttaaaaaatgaaatattaaataccaaaaaagcaattcaaaatgatttacagcaaattgcattaataccaggggctttaaatgaacagggatttgctatattcaaagaagtttatagtctttcaaaagaaattattgaaccggctgctcaagcaggggtggcagcgtataacaaaggaaaagaaattaacaactctattttagaagcggagaaaaaagcggcgcaagaagcgacagaacaaggtaaaactgctctagagattgaagcagcaaaaaaagcagctcgtgaagcaattgagaaaagcaaacaaggtgaaatagcagccgcagccgcagcaaaaacacaagagtatgacctgatgaaggtcattgataccgaaaagattaagaaaacatttggcgtttttgctgaagtaaataaattaacagcagaacagcgagcatatttagatgatttagagaaacaaaatcaaaaaatatatgatttaacaacgaaattatcaatagctgatttacaaaaatcaatgcttcttcttacacaaaatgatttgcatacgtttgcaaatcaagtagatgtagaacttgacctactaaagcgctataaagaagatttaaatctaataaaaaatagcattacaaaattatctactaatgttgatacaactaacgagcagtctcaaaaagatacattaagacaattaaaaaatgtaataagttaccttgaagaacaagtatataaattttga

SEQ ID NO: 248 - DNA, 1329 bp, Bacillus Sp.
gtgtacggaatgaagaataaaataatgacaggatttttaataacatccattgtaactggagcgaatattcctatcaatactctcgcaacaccaatcgttcaagcagaaactcaacaggaaaacatggatatttcttcatcattacgaaaattaggtgcgcaatctaaattaatccaaacgtatattgatcgatctttaatgagtcctaatgtacagctagaggaagtcccagctttaaatacaaatcaattcctaatcaaacaagatatgaaggaatggtcatcggaactctatccacagttaattctattaaattcaaaaagcaaaggatttgtaacaaaatttaatagctattatccgacattaaaatcgtatgtagacaataaagaagatagagaaggttttttggatagacttgaagtacttcaagaaatggctatgacgaatcaagaaaatgcgcaacgacaaattaatgagttaactgatcttaaattacagcttgataaaaaattaaaagatttcgatactgatgtggcaactgcgcaaggcatattaggtacagatggaacgggaaaaatagatcagttaaaaaatgaaatattaaatacaaaaaaagcaattcaaaatgatttacaacaaattgcattaataccaggagctttaaatgagcagggatttgctatattcaaagaaatttatagtctttcaaaagaaattattgaaccggctgctcaagcagggatggcagcgtataacaaaggaaaagaaattaacaactctattctagaagctgagaaaaaagcagcgcaagaagcgacagaacaaggtaaaactgctctagaaattgaatcggccaaaaaagcagctcgtgaagcaattgagaaaagcaaacaaggtgaaatagctgcagctgcagccgcaaaaacgcaagaatatgatctgatgaaagccattgatactgaaaagattaagaaaacatttggtgtcttcgcagaagtaaataaactaacagcagagcagcgatcatatttagatgacttagagaaacaaaaccaaaaaatatatgatttaacaacgaaactatcaatagcagatttgcaaaaatcaatgcttcttctttcacaaaatgatttgcatacgtttgcaaatcaagtagatgtagaacttgacctactaaagcgctataaagaagatttagatttaataaaaaataacattacaaaattatctactaatgttgatgtaactaacgagcagtctcaaaaagatacattaagacaattaaaaaatgtaataagttaccttgaagagcaggtatataaattttga

SEQ ID NO: 249 - DNA, 1329 bp, Bacillus Sp.
gtgtacggaatgaaaactaaaataattacaggattattagtcacatccattgtaactggaggaaatattcctatcaatactctcgcaacaccaatcgttcaagcagaaactcaacaggaaggcatggatatttcctcttcattacgaaaattaggtgcgcaatctaaattaatccaaacgtatattgatcaatctttaatgagtcctaatgtacagttagaggaagtcacagctttaaatacaaatcaattcctaatcaaacaagatatgaaggaatggtcatcggaactctatccacagttaattctattaaattcaaaaagcaaaggatttgtaacaaaatttaatagctattacccgacattaaaatcgtttgtagacaataaagaagatagagaagggttttcggatagacttgaagtacttcaagaaatggctatgacgaatcaagaaaatacgcaacggcaaatcaatgaattaacagatcttaaattacagcttgataaaaaattaaaagattttgataccaatgtggcaactgcgcaaggcatactaagtacagatggaacaggaaaaatagatcagttaaaaaatgaaatattaaatacaaaaaaagcaattcaaaatgatttacagcaaattgcattaataccaggggctttaaatgaacagggatttgctatattcaaagaagtttatagtctttcaaaagaaattattgaaccagctgcgcaagcaggggtggcagcatataacaaaggaaaagaaattaacaactctattctagaagctgagaaaaaagcagtgcaagaagcaacagagcaaggtaaaacggctctagagattgaatcagcaaaaaaagcagctcgtgaagcaattgagaaaagcaaacaaggtgaaatagcagccgcagccgcagcaaaaacacaagagtatgacctgatgaaggtcattgataccgaaaagattaagaaaacatttggcgtttttgctgaagtaaataaattaacagcagaacagcgagcatatttagatgatttagagaaacaaaatcaaaaaatatatgatttaacaacgaaattatcaatagctgatttacaaaaatcaatgcttcttcttacacaaaatgatttgcatacgtttgcaaatcaaatagatgtagaacttgatctactaaagcgctataaagaagatttaaatctaataaaaaatagcattacaaaattatctactaatgttgatacaactagcgagcagtctcaaaaagatacattaagacaattaaaaaatgtaataagttaccttgaagaacaagtatataaattttaa

SEQ ID NO: 250 - DNA, 1362 bp, Bacillus Sp.
atgaatcaagttataaaaaacaatggtaaaggagtgtacggaatgaaaaataagataatgacaggatttttaataacatccattgtaactggagcaactattcctatcaatactctcgcaacaccaatcgttcaagcagaaactcaacaggaaagcatggatatttcttcatcattacgaaaattaggtgcgcaatctaaattaatccaaacgtatattgatcaatctttaatgagtcctaatgtacagctagaggaagtcccagcattaaataccaatcaattcctaatcaaacaagatatgaaggaatggtcatcagaactctatccacagttaattctattaaattcaaaaagtaaaggatttgtaacgaaatttaatagctattacccgactttaaaatcgtatgtagacaataaagaagatagagaaggttttttggatagacttgaagttcttcaagaaatggctatgacgaatcaagaaaatgcgcaacgacaaattaatgagttaactgatcttaaattacagcttgataaaaaattaaaagatttcgatactgatgtggtaactgcgcaaggcatagtaggtacagatgggacaggaaaaatagatcagttaaaaaatgaaatattaaataccaaaaaagcaattcaaaatgatttacaacaaattgcattaataccaggagctttaaatgagcagggatttgctatattcaaagaagtttatagtctttcaaaagaaattattgaaccagctgctcaagcagggatggcagcgtataacaaaggaaaagaaattaacaactctattctagaagcggagaaaaaagcggcgcaagaagcgacagaacaaggtaaaactgctctagagattgaatcggccaaaaaagcagctcgtgaagcaattgagaaaagcaaacaaggtgaaatagctgcagctgcagccgcaaaaacgcaagaatatgacctgatgaaagccattgatactgaaaagattaagaaaacatttggtgtcttcgcagaagtaaataaactaacagcagagcagcgagcatacttagatgacttagagaaacaaaaccaaaaaatatatgatttaacaacgaaactatcaatagcagatttacaaaaatcaatgcttattcttacacaaaatgatttgcatacgtttgcaaatcaagtagatgtagaacttgacctactaaagcgctataaagaagatttggatctaataaaaaatagcattacaaaattatctactaatgttgatacaactaacgagcagtctcaaaaagatacattaagacaattaaaaaatgttataagttaccttgaagaacaggtatataaattttaa

SEQ ID NO: 251 - DNA, 1383 bp, Bacillus Sp.
gtgctaggtcgtacaagttatatgaatcaatttatagaaaaaaatggtaaaggagtgtacggaatgaagaataaaataatgacaggatttttaataacatccattgtaactggagcgactattcctatcaatactctcgcaacaccaatcgttcaagcagaaactcaacaggaaaacatggatatttcttcatcattacgaaaattaggtgcgcaatctaaattaatccaaacgtatattgatcaatctttaatgagtcctaatgtacagctagaggaagtcccagctttaaatacaaatcaattcctaatcaaacaagatatgaaggaatggtcatcggaactctatccacagttaattctattaaattcaaaaagcaaaggatttgtaacaaaatttaatagctattatccgacattaaaatcgtatgtagacaataaagaagatagagaaggttttgtggatagacttgaagtacttcaagaaatggctatgacgaatcaagaaaatgcgcaacgacaaattaatgagttaactgatcttaaattacagcttgataaaaaattaaaagatttcgatactaatgtggcaactgcgcaaggcatattaggtacagatggaacaggaaaaatagatcagttaaaaaatgaaatattaaataccaaaaaagcaattcaaaatgatttacaacaaattgcattaataccaggagctttaaatgagcagggatttgctatattcaaagaaatttatagtctttcaaaagaaattattgaaccggctgctcaagcggggatggcagcgtataacaaaggaaaagaaattaacaactctattctagaagcggagaaaaaagcagcgcaagaagcgacagaacaaggtaaaactgctctagagattgaatcggccaaaaaggcagctcgtgaagcaattgagaaaagcaaacaaggtgaaatagctgcagctgcagctgcaaaaacgcaagaatatgacctgatgaaagccattgatactgaaaagattaagaaaacatttggtgtcttcgcagaagtaaataaactaacagcagagcagcgatcatatttagatgacttagagaaacaaaaccaaaaaatatatgatttaacaacgaaactatcaatagcagatttgcaaaaatcaatgcttcttctttcacaaaatgatttgcatacatttgcaaatcaagtagatgtagaacttgacctactaaagcgctataaagaagatttggatcaaataaaaaataatattacaaaattatctactaatgttgatgcaactaacgagcagtctcaaaaagatacattaagacaattaaaaaatgtaataagttaccttgaagaacaggtatataaattttga

SEQ ID NO: 252 - DNA, 1407 bp, Bacillus Sp.
atgcgtgtgcaaggagagagcctagcgctagggcgtacaagttatatgaatcgagttataaaaaacaatggtaaaggagtgtacggaatgaaaaataaaataatgacaggatttttaataacatccattgtaactggagcaactattcctatcaatactctcgcaacaccaatcgttcaagcagaaactcaacaggaaagcatggatatttcttcatcattacgaaaattaggtgcgcaatctaaattaatccaaacgtatattgatcaatctttaatgagtcctaatgtacagctagaggaagtcccagctttaaataccaatcaattcctaatcaaacaagatatgaaggaatggtcatcagaactctatccacagttaattctattaaattcaaaaagtaaaggatttgtaacgaaatttaatagctattacccgacattaaaatcgtatgtagacaataaagaagatagtgaagggtttttggatagacttgaagttcttcaagaaatggctatgacgaatcaagaaaatgcgcaacgacaaattaatgaattaacagaacttaaattacagcttgataaaaaattgaaagatttcgatactgatgtggcaacagcacaaggcatactaagtacagatggaacagggaaaatagatcagttaaaaaatgaattattaaataccaagaaagcaattcaaaatgatttacaacaaattgcattaataccaggagctttaaatgagcagggatttgctatattcaaagaagtttatagtctttcaaaagaaattattgaaccggctgctcaagcagggatggcagcgtataacaaaggaaaagaaattaacaactctattctagaagcagagaaaaaagcagcgcaagaagcgaaagagcaaggtaaaactgctctagaaattgaatcagccaaaaaagcagctcgtgaagcaattgagcgaagcaaacaaggtgaaatagctgcagctgcagccacaaaaacgcaagaatatgacctgatgagagccattgatactgaaaagattaagaaaacatttggtgtcttcgcagaagtaaataaactaacagcagagcagcgagcatatttagatgacttagagaaacaaaaccaaaaaatatatgatttaacaacgaaactatcaatagcagatttacaaaaatcaatgcttcttctttcacaaaatgatttgcatacgtttgcaaaccaagtagatgtagaacttgacctactaaagcgctataaagaagatttggatctaataaaaaataacattacaaaattatctactaatgttgatgcaactaacgagcagtctcaaaaagatacattaagacaattaaaaaatgtaataagttaccttgaagaacaggtatataaattttga

SEQ ID NO: 253 - DNA, 1323 bp, Bacillus Sp.
gtgaaaaatgaaatcactaaaggttgtataataacatcacttatttttggggcagctgtttctaccaatgttttcttaactcctgtagttcttcaggctgaaactcaacaagaacgaacggatatttctccatctttacagcaattaggtgtacactctaagttcatacaaacacatatagatcaagttttgacaactcctaatatagaattggaggaaatcccagttttaaatacgaatcaatccttaattaaacaggatatgaaagaatggtcatcgaagatttctccaaatttatttctattaaattcaaagagtaaaggatttgtaactaaatttaataactattattcaacattaaaaggatttgtggataataaaaaagataaagaaggatttgtagatagactagaagtccttcaagaaatgactattacgaaccaagaaaacttgcaacgtcagattaatgaattaacagagtttaaattacagcttgataaaaaaattgaaaatcttgataccaatgtaaaaaaagggcatgaggcactagtatcagatggaacaagaaaaatagaccagattgaaaatgaattaatgaataccaaaaaattaattcgaactaatttacaaggaatagcgcttttaccaggagctttaaatgagcaaggattaaaggtattccaagaagtctatcatctatcaaaagatatcattgaaccagctactcaaacagcagtagcagcgtataacaaagggaaagaaataaaaaactccattgttgaagcagtgaagaaagccgcgaaagaagcgaaagaaaagggtaaatctgaattagagattgaagctgccaaaaaagaagcacgtgaagcaattgagaaaagcaaaaaaggtgaaatggctgcagctgcggctgcagaaacgaaagagtatgaccttatgaaagcagttgatcctgaaaaaatcaaaaacacacttagtacttttgctaaaattaacaaactaacggcagatcagcaagctcatttaaatgatttagcggaacaaaaccaaaagttatatgacttaacgaagaagctaacaattgcagatttacaaaaatcaatgattctttttatgcaaaatgacttacaaacatttgcagatcaagtgaatttagaacttgatctaatgaaacgctataaagaagatttgaatctaatcaaaaacagtattacaactttatctactaatgttgatactactaaccaggcatctcaaaaagatacattaagacgattaaaaaacattacaagttaccttggtgaacaagttgataagttttaa

SEQ ID NO: 254 - DNA, 1230 bp, Bacillus Sp.
atgatgaaatttccatttaaggttataactttagccactttagcaacggttataactgctacgaatggtagtactattcatgcacttgcacaagaacagacagctcaggaacagaaaatagaaaattatgcgttaggacctgatggattaaagaaagcgttggctgaaacaggctctcatattcttgtaatggatttgtacgcaaaaactatgattaagcaaccgaatgtaaatttatccaatattgatttaggttccggaggaggagaattaatcaaaaatattcacctaaatcaggaactgtcacgaatcaatgcaaattactggttagatacagcgaagccaaacattcaaaaaacagcacgtaatattgtaaattatgatgagcaatttcaaaactattacgacacattagtagacactgtaaaaaagaaagataaggtgagcctcaaagaaggaataggggatttaatcgatacaattcatacaaattcaaatgatgttacggaagtcattaagatgttagaggcttttaaaacaaagttgtatacaaatactgtagattttaaaaataatgttggtggtccagatggacagggcggattgacggctatattagcgggaaaacaagcactagtcccacaacttcaggccgaaattgagaatttacgttctacacagaaatcacattttgataatgtattagcctggtcaattggtggtggattaggagctgctattttagttattggaacgattgcaggagcggtagtaattgttgtgacgggtggtacagctacaccagctgttgtgggtggtcttacagctctaggagccgctggtatcggtttaggaacagctgctggtgtcgaggcatctaatcatatgaattcttataatgaaatttcgaataaaatcggagaattaagtatgaaagctgatctggctaatcaagcggttatttcacttactaataccaaggacactctaacatatttgtatcagacagtggaccaagcaatcatgtctctaacaagtattcagcaacaatggaataaaatgggggctaattataaagatttatatgataatatcgatcaaatgcaagaacataaactttcgttaatacctgacgatttaaaagctgctaaacaaagttggaatgatattcataaggacgcagaattcatttccaaagacattgcttttaaacaagaaaagacaaactaa

SEQ ID NO: 255 - DNA, 1230 bp, Bacillus Sp.
atgatgaaatttccatttaaggttataactttagccactttagcaacggttataactgctacgaatggtagtactattcatgcacttgcacaagaacagacagctcaagaacataaaatagaaaattatgcgttaggacctgaagggttaaagaaagcgttggctgcaactggctctcatattcttgtaatggatttgtacgcaaaaactatgattaagcaaccgaatgtaaatttatccaacattgatttaggttcaggaggagaagaattaatcaaaaatatccacctgaatcaagaactgtcacgaatcaatgcaaattactggttagatacagcgaagccaaacattcaaaaaacagctcgtaatattgtaaattatgatgagcaattccaaaattattacgacacattagtagatactgtaaaaaagaaagataagatgagccttaaagaaggaataggggatttaatcgatacaattcatacaaattcaaatgaagttacggaagtcattaagatgttagaggctttcaaaacaaagttgtatacaaatactgtagattttaaaaataatgttggtggtccagatggacagggaggattgacggctatattagcgggaaaacaagcactagtcccacaacttcaggccgaaattgagaatttacgttctacacagaaatcacattttgataatgtattagcctggtcaattggcggtggactaggagcagctattttagttattggaacgattgcaggagcggtagtaattgttgtgactggtggtacagctacaccagctgttgttggcggtcttacagctctaggagcagctggtatcggtttaggaacagcagctggtgtcgaggcatctaatcatatgaattcttataatgaaatttcgaataaaatcggagaattaagtatgaaagctgatctggctaatcaagcggttatttcacttactaatacgaaagacactctaacatatttgtatcagacagtggatcaagcaataatgtctctaacaagtattcagcaacaatggaataaaatgggggctaattataaagatttatatgataatatcgatcaaatgcaagaacataaactttcgttaatacctgacgatttaaaagctgctaaacaaagttggaatgacattcataaggacgcagaattcatttcaaaagacattgcttttaaacaagaaaaaacaaactaa

SEQ ID NO: 256 - DNA, 1227 bp, Bacillus Sp.
atgaaatttccatttaaggtcataactttggccactttagcaacggttataactgctacgaatggtagtactattcacgcacttgcacaagaacagacagcacaagaacagaaaatagaaaattatgcgttaggacctgaagggttaaagaaagtgttggctgaaacaggctctcatattcttgtaatggatttgtacgcaaaaacaatgattaagcaaccgaatgtaaatttatccaacattgatttaggttcaggagggggagaattaatcaaaaacattcacctgaatcaggaactgtcacgaatcaatgcaaattactggctagatacagcgaagccaaacattcaaaagacagcacgtaatattgtaaattatgatgaacaatttcaaaattattacgacacactagtagatactgtaaaaaagaaagataaggcgggcctcaaagaaggaataggggatttaatcggtacaattcatacaaattcaaatgaagttacggaagttattaagatgttagaagctttcaaaacaaagttgtatacaaatactgtagattttaaaaataatgttggaggtccagatggacaagggggattaacggctatattagcgggaaaacaagcactattcccacaacttcaggccgaaattgagaatttacgttctacgcagaaagcacattttgataatgtattagcctggtcaattggtggtggattaggagcagctattttagttattggaacgattgcaggagcggtagtaattgttgtgaccggtggcacagcgacaccagctgttgttggtggtctaacagctctaggggcagctggtatcggtttaggaacagcagctggtgttgaggcatctaatcatatgaactcctataatgaaatttcgaataaaattggagaattaagtatgaaagctgatttagctaaccaagcagttatttcacttactaatacaaaagacactttaacatatttatatcaaacagttgatcaagcaattatgtctctaacaagtattcagcaacaatggaatacgatgggagcgaattataaagatctatatgataatatcgaccaaatgcaagaacataaactttctttaatacctgatgatttaaaggctgcaaaacaaagttggaatgatattcataaggatgcagaattcatttcaaaagacattgcttttaaacaagaaaaaacaaattaa

SEQ ID NO: 257 - DNA, 1230 bp, Bacillus Sp.
atgatgaaatttccatttaaagtcataactttagccactttagcaacggttatgactgctacgaatggtagtactattcatgcacttgcacaagaacagacagctcaagaacagaaagtagaaaactatacgttaggacctgaaggattaaagaaagcgttggctgaaacaggctctcatattctggtaatggatttgtacgcaaaaactatgattaagcaaccaaatgtaaatttatccaacattgatttaggttcaggagggggagaattaatcaaaaacattcacctgaatcaggaattgtcacgaatcaatgcaaattactggctagatacagcgaagccaaacattcaaaagacggcacgtaacattgtaaattatgatgaacaatttcaaaattactacgacacattagtagatactgtaaaaaagaaagataagacgagcctcaaagaaggtataggtgatttaatcggtacaattcatacaaattcaaatgaagttacggaagtcattaagatgttagaagctttcaaaacaaagttgtatacaaatactgtagattttaaaaataatgttggaggtccagatggacaggggggattaacagctatattagcagggaaacaagcactagccccacaacttcaagccgaaattgagaatttacgttctacacagaaagcacattttgataatgtattagcctggtcaattggtggaggattaggagccgctattttagttattggaacaattgcaggagcggtagtaattgttgtgtctggtggcacggcgacgccagctgttattggtggcctaacagctctaggggcagctggtatcggtttaggaacagctgctggtgttgaggcatctaatcatatgaactcctataatgaaatttcgaataaaattggagaattaagtatgaaagctgatttagctaaccaagcagttatctcacttactaatacaaaagacactttaacatatttgtatcaaacagtggatcaagcaattatgtctctaacaagtattcagcaacaatggaatgcaatgggagcaaattataaagatttatatgataatatcgatcaaatgcaagaacataaactgtcgttaatacctgatgatttaaaggctgctaaacaaagttgggatgatattcataaggacgcagaattcatttcaaaagacattgcttttaaacaagaaaagacaaactga

SEQ ID NO: 258 - DNA, 1242 bp, Bacillus Sp.
atgaaatttccatttaaggtcataactttggccactttagcaacggttataactgctacgaatagtagtactattcacgcacttgcacaagaacagacagcacaagaacagacagcacaagaacagaaaatagaaaattatgcgttaggacctgaagggttaaagaaagtgttggctgaaacaggctctcatattcttgtaatggatttgtacgcaaaaacaatgattaagcaaccgaatgtaaatttatccaacattgatttaggttcaggagggggagaattaatcaaaaacattcacctgaatcaggaactgtcacgaatcaatgcaaattactggctagatacagcgaagccaaacattcaaaagacagcacgtaatattgtaaattatgatgaacaatttcaaaattattacgacacgctagtagatactgtaaaaaagaaagataaggcgggcctcaaagaaggaataggggatttaatcggtacaattcatacaaattcaaatgaagttacggaaattattaagatgttagaagctttcaaaacaaagttgtatacaaatactgtagattttaaaaataatgttggaggtccagatggacaagggggattaacggctatattagcgggaaaacaagcactagtcccacaacttcaggccgaaattgagaatttacgttctacgcagaaagcacattttgataatgtattagcctggtcaattggtggtggattaggagcagctattttagttattggaacgattgcaggagcggtagtaattgttgtgaccggtggcacagcgacaccagctgttgttggtggtctaacagctctaggggcagctggtatcggtttaggaacagcagctggtgttgaggcatctaatcatatgaactcctataatgaaatttcgaataaaattggagaattaagtatgaaagctgatttagctaaccaagcagttatttcacttactaatacaaaagacactttaacatatttgtatcaaacagttgatcaagcaattatgtctctaacaagtattcagcaacaatggaatacgatgggagcgaattataaagatctatatgataatatcgaccaaatgcaagaacataaactttctttaatacctgatgatttaaaggctgcaaaacaaagttggaatgatattcataaggatgcagaattcatttcaaaagacattgcttttaaacaagaaaaaacaaattaa

SEQ ID NO: 259 - DNA, 1200 bp, Bacillus Sp.
ttggccactttagcaacggttataactgctacgaatggtagtactattcacgcacttgcacaagaacagacagcacaagaacagaaaatagaaaattatgcgttaggacctgaagggttaaagaaagtgttggctgaaacaggctctcatattcttgtaatggatttgtacgcaaaaacaatgattaagcaaccgaatgtaaatttatccaacattgatttaggttcaggagggggagaattaatcaaaaacattcacctgaatcaggaactgtcacgaatcaatgcaaattactggctagatacagcgaagccaaacattcaaaagacagcacgtaatattgtaaattatgatgaacaatttcaaaattattacgacacactagtagatactgtaaaaaagaaagataaggcgggcctcaaagaaggaataggggatttaatcggtacaattcatacaaattcaaatgaagttacggaaattattaagatgttagaagctttcaaaacaaagttgtatacaaatactgtagattttaaaaataatgttggaggtccagatggacaagggggattaacggctatattagcgggaaaacaagcactagtcccacaacttcaggccgaaattgagaatttacgttctacgcagaaagcacattttgataatgtattagcctggtcaattggtggtggattaggagcagctattttagttattggaacgattgcaggagcggtagtaattgttgtgaccggtggcacagcgacaccagctgttgttggtggtctaacagctctaggggcagctggtatcggtttaggaacagcagctggtgttgaggcatctaatcatatgaactcctataatgaaatttcgaataaaattggagaattaagtatgaaagctgatttagctaaccaagcagttatttcacttactaatacaaaagacactttaacatatttgtatcaaacagttgatcaagcaattatgtctctaacaagtattcagcaacaatggaatacgatgggagcgaattataaagatctatatgataatatcgaccaaatgcaagaacataaactttctttaatacctgatgatttaaaggctgcaaaacaaagttggaatgatattcataaggatgcagaattcatttcaaaagacattgcttttaaacaagaaaaaacaaattga

SEQ ID NO: 260 - DNA, 1200 bp, Bacillus Sp.
ttggccacgttagcaacggttataactgctacgaatggtagtactattcatgcacttgcacaagaacagacagcacaagaacagaaaatagaaaattatgcgttaggacctgaagggttaaagaaagtgttggctgaaacaggctctcatattcttgtaatggatttgtacgcaaaaacaatgattaagcaaccgaatgtaaatttatccaacattgaattaggttccggagggggagaattaatcaaaaacattcacctgaatcaggaactgtcacgaatcaatgcaaattactggttagatacagcgaagccaaacattcaaaagacagcacgtaatattgtaaattatgatgaacaatttcaaaattattacgacacactagtagacactgtaaaaaagaaagataaggcaggcctcaaagaaggaataggggatttaatcggtacaattcatacaaattcaaatgaagttacggaagttattaagatgttagaagctttcaaaacaaagttgtatacaaatactgtagattttaaaaataatgttggaggtccagatggacaggggggattagcggctatattagcgggaaaacaagcactagtcccacaacttcaggccgaaattgagaatttacgttctacgcagaaagcacattttgataatgtattagcctggtcaattggtggtggattaggaacagctattttagttattggaacgattgcaggagcggtagtaattgttgtgactggtggcacagcgacaccagctgttgttggtggtctagtagctctaggggcagctggtattggtttaggaacagcagctggtgttgaggtatctaatcatatgaactcctataatgaaatttcgaataaaattggagaattaagtatgaaagctgatctagctaaccaagcagttatttcacttactaatacaaaagacactttaacatatttgtatcaaacagttgatcaagcaattatgtctctaacaagtattcagcaacaatggaatacaatgggagcaagttataaagatttatatgataatatcgatcaaatgcaagatcataaactttcgttaatacctgacgatttaaaggctgcaaaacaaagttggaatgatattcataaggatgcagaattcatttcaaaagacattgcatttaaacaagaaaaaacaaactaa

SEQ ID NO: 261 - DNA, 1272 bp, Bacillus Sp.
atgaaatttccatttaaggtcataactttggccactttagcaacggttatcactgctacgaatggtagtactattcatgtacttgcacaagaacagacagcacaagaacagacagcacaagaacagacagcacaagaacagacagcacaagaacagcaaatagaaaattatgcgttaggacctgaagggttaaagaaagtgttggctgaaacaggctctcatattcttgtaatggatttgtacgcaaaaacaatgattaagcaaccgaatgtaaatttatccaacattgatttaggttcaggaggtggagaattaatcaaaaacattcacctgaatcaggaactgtcacgaatcaatgcaaattactggctagatacagcgaagccaaacattcaaaagacagcacgtaatattgtaaattatgatgaacaatttcaaaattattacgacacactagtagatactgtaaaaaagaatgataaggcgggcctcaaagaaggaataggggatttaatcggtacaattcatacaaattcaaatgaagttacggaagttattaagatgttagaagctttcaaaacaaagttgtatacaaatactgtagattttaaaaataatgttggaggtccagatggacaagggggattaacggctatattagcgggaaaacaagcactagtcccacaacttcaggccgaaattgagaatttacgttctacgcagaaagcacattttgataatgtattagcctggtcaattggtggtggattaggagcagctattttagttattggaacgattgcaggagcggtagtaattgttgtgaccggtggcacagcgacaccagctgtcgttggtggtctaacagctctaggggcagctggtatcggtttaggaacagcagctggtgttgcggcatctaatcatatgagctcctataacgaaatttctaataaaatcggagaattaagtatgaaagccgatcttgctaaccaagcagttatttcacttactaatacaaaagacacgttgacatatttgtatcaaacagtggatcaagcaatcatgtctttaacgaatattcagcaacaatggaatacgatgggagcgaattataaagatctatatgataatatcgaccaaatgcaagaacataaactttctttaataccggatgatttaaaggctgcaaaacaaagttggaatgatattcataaggatgcagaattcatttcaaaagacattgcttttaaacaagaaaaaacaaattaa

SEQ ID NO: 262 - DNA, 1230 bp, Bacillus Sp.
atgaaaaaaactccatttaaggtgttaacttttatcactttggcatcaattataactactactaacggtagtgctattcatgtatttgcacaagatcggactttacaagaacaaaaaatagaaatttatacattaggacctgaagggctaaagaaagaattggctaaaaccggatctaatattctcgtaatggacttgtacgcaaaaacaatgattaaacagccaaacgtaaacttatccagtattgatttaggttcaggaggagaagaattaatcaaaaacattcaattgaatcaggaattatcacgaatcaatgcaagttactggttagatacagcgaagccaaagattcaaaaaacagtacgtaacattgtaaattatgatgagcaatttcaaaattattacgacacattagtagatactgtaaaaaagaatgataagatgaacctcaaagaaggaataggggatttaatccatacaattcatacaaattcaaatgaagttacggaagtcattaagatgttagaggctttcaaaacaaagttgtatacaaatactgtagactttaaaaataatgttgggggccctgatggtaagggtggattaacggctatactagccggaaaacaggcattggttccacaacttcaggctgaaattgagaatttacgttctacgcagaaattacattttgataatgtattagcctggtcaattggtggtggattaggagcagctattttagttattggagcgattgcaggagcggtagtaattgttgtgactggtggtacagctacaccagctgttgttggcggtcttacagctctaggagcagctggtatcggtttaggaacagcagctggtgttgaggcatctaatcatatgaattcctataatgaaatttcaaataaaatcggagaattaagtatgaaagctgatttagctaaccaagcggttatatcacttactaatacaaaagacactttaacatatttgtatcagacagtggatcaagcgataatgtctctaacaagtattcagcaacaatggaataaaatgggagctaattataaagatttatatgataatatcgatcaaatgcaagaacataaactatctttaatacctgatgatttaaaggctgctaaacaaagttgggatgaaattcataaggacgcagaattcatttcaaaagacattgcttttaaacaagaaaaaacaaactga

SEQ ID NO: 263 - DNA, 1110 bp, Bacillus Sp.
atgatgaaatttccatttaaggttataactttagccactttagcaacggttataactgctacgaatggtagtactattcatgcacttgcacaagaacagacagctcaagaacataaaatagaaaattatgcgttaggacctgaagggttaaagaaagcgttggctgcaactggctctcatattcttgtaatggatttgtacgcaaaaactatgattaagcaaccgaatgtaaatttatccaacattgatttaggttcaggaggaggagaattaatcaaaaatatccacctgaatcaggaactgtcacgaatcaatgcaaattactggttagatacagcgaagccaaacattcaaaaaacagctcgtaatattgtaaattatgatgagcaattccaaaattattacgacacattagtagatactgtaaaaaagaaagataagatgagccttaaagaaggaataggggatttaatcgatacaattcatacaaattcaaatgaagttactgacgtcattaagatgttagaggctttcaaaacaaagttgtatacaaatactgtagattttaaaaataatgttggtggtccagatggacagggaggattgacggctatattagcgggaaaacaagcactagtcccacaacttcaggccgaaattgagaatttacgttctacacagaaatcacattttgataatgtattagcctggtcaattggcggtggactaggagcagctattttagttattggaacgattgcaggagcggtagtaattgttgtgactggtggtacagctacaccagctgttgttggcggtcttacagctctaggagcagctggtatcggtttaggaacagcagctggtgtcgaggcatctaatcatatgaattcttataatgaaatttcgaataaaatcggagaattaagtatgaaagctgatctggctaatcaagcggttatttcacttactaatacgaaagacactctaacatatttgtatcagacagtggatcaagcaataatgtctctaacaagtattcagcaacaatggaataaaatgggggctaattataaagatttatatgataatatcgatcaaatgcaagaa

SEQ ID NO: 264 - DNA, 1245 bp, Lysinibacillus Sp.
gtgaagaaatttccatataaagtgttgagcgtggtcactctggcaacggttataactgctactaacagtagttctattcatgcacttgcacaagaacagaatgttcaacaacagattgctcaagtacagaacataggaaattatgaactaggacctgaaggactgaagaaagcgttggctgaaacaggttctcatatacttgtcatggatttgtacgcaaaaacaatgattaaacaaccgaatgtaaatctatccaatattgatttaggttcagaagggggagaattaatcaaaaatattcaccttaatcaggaactatctcgaatcaatgcaaattattggttagataccgcgaaaccaaagattcaaaagacagcacgtaatattgtcaattacgatgaacaatttcagaattattaccacacattagtagattttgtacaaaagaaagataaggaaggcttaaaagaaggcataggtgatttagtcagtacaattgatataaattcaaaagaagtgacagaagtaattaaaatgttagaagccttcaaaacaaaactgtatacaaatactatagattttaaaaataatgtgggtggtccagatgggaagggtggattaacagccatattagcgggaaaacaagcactggttccacaacttcaagctgaaattgaacaactacgttctactcagaaagcacattttgacaatgtattagcatggtcaattggtggtggattgggagcagccattttagttattggcactattgcaggaggggtcgtaattgttgtgactggcggcacagcgacaccagttgttgtgggtggccttacagctctcggtgctgcgggcattggtttaggtacagcagctggtgttgtggcgtctaatcacatgaactcctataacgaaatttcgaataaaattggagaattaagcatgaaagccgatcttgctaatcaagcagttatttcacttactaacacaaaagacactctgacatatctgtatcagacagtagatcaagcgataatgtctctaacaaatattcaacaacaatggaatactatgggggcaaattataaagatttatatgataatatcgatcaaatgcaagaccataagctctctttaatacctgatgatttaaaagctgccaaacaaagttggaatgatattcataaagacgcagaatttattgcaaaagacattgcttttaaacaagaagaaatgaactaa

SEQ ID NO: 265 - DNA, 1233 bp, Bacillus Sp.
atgaagaaattttcatataaagtgttaaccgtggctactttggcaacgattattaccgcagctaacagtggcactattcaggcacttgcgcaagaacaggtcactcaagaacaaaaaatagggaattattatacattaggacctgaaggattgaagaaagccttagctgaaacagggtctcatattcttgtaatggatttatacgcaaaaacaatgattaaacagccgaatgtaaacctatccaaaattgatttaggttctgaaggaggagaattaatcaaaaatattcaccttaatcaggaactgtctcgaatcaatgcgaattattggttagatacggcgaagccaaaaattcaaaagacagcacgtaatattgtaaattacgatgaacaatttaataattattacgacacattaatagacactgtacaaaagaaagataaggaaggattaaaagaaggcattggtgatttaatcagtacgattaatacaaattcaaaagaagttacagaagtaattaagatgttagaagccttcaaaacaaagctatatacaaatactatagattttaaaaataatattggtggtccggatgggaaaggtggattaacggcaatattagccggaaaacaagctttggttccacaacttcaagctgaaattgagaatctacgtgctactcagaaagcacattttgataatgtattagcatggtcaattggtggtggattgggagcagccattttagttattggaaccattgcaggtggggtagtaattgttgtaactggtggtacagcaactccgcttgttgtaggtggtcttacagttcttggtgcagctggtattggtttaggaacagcagctggtgttacggcatctaatcatatgagctcttacaacgaaatatctaataaaatcggagaattaacgatgaaagccgattttgctaaccaagcaattatttcacttagtaacgcaaaagacactttgacatacttatatcaaacagtggatcaagcgataatgtctctaacgaatattcagcaacaatggaatacaatgggggcaaattataaagatttatatgataatatcgatcaaatgcaagatcataagctttctttaatacctgatgatttaaaagcggctaaacaaagttggaacgatattcataaagatgcggaatttattgcaaaagacattgcttttaaacaagaagataagaattga

SEQ ID NO: 266 - DNA, 1245 bp, Bacillus Sp.
atgatgaaatttccatttaaggtcataacattggctacattggcaacggttataacgactactaatggtagcgctattcatgcacttgcacaagaacaaactgcacaaaaacaaactgcacaagaacagaaaacagaaaattatatgttagggcctgaagggctaaagaaagcgttggctgaaaccggctctcatattcttgtaatggatttgtacgcaaaaacaatgatcaaacaaccaaatgtaaatttatcaaatattgatttaggttcaggaggagcagaattagtcaaaaacattcacctaaatcaggaattgtcacgaatcaatgcgaatttctggttagatacagcgaaaccaagcattcaaaagacggcacgtaatattgtaaattatgatgaaaaatttcaaaattattacaatacactagtggatactgtaaaaaagaaagataaggagggcctcaaagaaggtctaggtgatttaatcggtacaattcgtacaaattcaaaagaagttacagaagtcataaaggtgttacaggatttcaaatcaaagctgtatacaaattctacagattttaaaaaaaatgttggtggcccagatgggaaaggtggactaacggcaatattagcaggacaacaagctacaatcccacaacttcaagctgaaattgagcaactcctttctactcagaaaaaacattttgacgatgtattggcatggtcaattggcggtgggctaggcgcaactattttagctattggagctattggaggagcagtactaattgttgtgactggcggtacggcgacagcagctgttgtcggtggcctttcggttcttggtgcagctggaattggtttaggaacagcagcaggggttgaggcaactaatcatatgaactcctataacgaaatttcaaataaaattggagagttaagtatgaaagctgatcgtgctaaacaagcagttatttcacttgctagcacaaaagacactttgacatacttgtatcaaacagtggatcaagcaataatgtctctgacaaatattcagcaacaatggaatacgatgggagcaaattataaagatttatatgataatatcgatcaaatgcaagaacataaactaactttaataccggatgatttaaaggctgctaaacaaagttggaatgatattcataaggatgcagaattcatttcaaaagacattgcttttaaacaagaaaaatcaaactga

SEQ ID NO: 267 - DNA, 1221 bp, Bacillus Sp.
atgaaaaaattcccatttaaagtgttgactttagcaactctggcaacggttataactgctacgaccggtaacactattcatgcatttgcacaagaaacgaacgctcaagaacaaaaagtagggaattatacattaggacctgaaggactgaagaaagcattagctgaaacaggatcccatattcttgtaatggatttgtacgcaaaaacaatgattaaacaaccgaatgttaatttatctgatatcgatttaggttcaggaggtggagagttactcaaaaatattcaccttaatcaagagctgtcgcgaatcaatgcgaattattggttagatacagcgaagccacagattcaaaaaacagcacgtaatattgtaaattacgatgaacaatttcaaaattattatgacacattagtagatactgtacaaaagagagataaggcaggcctaaaagagggcataaatgatttaatcactacaattaatacaaattcaaaagaagttacagatgtaattaagatgttacaagacttcaaatcaaaactgtatacaaattctacagattttaaaaataatgttggtggcccggatgggaaaggtggattaacggcaatactagcgggacaacaagcactgattccacaacttcaagctgaaattgagcaactaagtgctactcagaaaaaacattttgacgatgtattagcatggtcaattggtggtggattgggagcagccattttagttattggagctattgcaggagcggtagtaattgttgtgactggcggtacagcaacaccggctgttgttggtggcctttcggctcttggtgcagctggaattggtttaggaacagcagctggtgtcacagcgtctaatcatatgaactcctataacgaaatctctaaaaaaatcggagaattaggtacgaaagctgatcgtgctaaccaagcagttatttcgcttactaacgcgaaagacacattggcatatctgtatcaaacagtggatcaagcgatactgtctctaacaaatattcaaaagcaatggaatacaatgggggccaactatacagatttacttgataatatcgactctatgcaagaacataaattctctttaataccggatgatttaaaagctgctaaacaaagttggaatgacattcataaagatgcagaattcatttcaaaagacattgcttttaaacaagaatag

SEQ ID NO: 268 - DNA, 1224 bp, Bacillus Sp.
gtgatgaaaaaattcccattcaaagtgctaactttagccactctggcaacggttataactgctactactggtaacactattcatgcatttgcacaagaaacgaccgctcaagaacaaaaagtaggcaattatgttttaggtcctgagggactgaagaaagcattggctgaaacagggtctcatattcttgtaatggatttgtacgcaaaaacaatgattaagcaaccgaatgtaaatttatctaatatcgatttaggatcagaaggaggagagttgctcaaaaatattcaccttaatcaagaactgtcacgaatcaatgcgaattattggttagatacagcgaagccacagattcaaaaaacagctcgtaatattgtaaattacgatgaacaatttcaaaattattacgacacattagtagatactgtacaaaagaaagataaggcaggtctaaaagagggcataaatgatttaattacaacaattaatacaaattcaaaagaggtaacagatgtaattaagatgctacaagacttcaaagggaaactatatcaaaattctacagattttaaaaataatgttggtggtccagatgggaaaggtggattaactgcaatattagcaggtcaacaagcaacgattccacaacttcaagctgaaattgagcaacttcgttctactcagaaaaaacattttgatgatgtattagcatggtcaattggtggtggattgggagcagctattttagttattgcagctattggaggagcagttgtaattgttgtaactggtggtacagcaacaccggctgttgttggtggactttcagctcttggagcagctggtatcggtctaggaactgcggctggtgtcacggcatctaagcatatggactcctataacgaaatttctaacaaaatcggggaattaagtatgaaagcagatcgtgctaatcaagcagttctttcgcttactaacgcgaaagaaacattggcatatctataccagactgtagatcaagcgatattgtctctaacaaatattcaaaagcaatggaatacaatgggcgcaaattatacagatttactggataatatcgattctatgcaagaccacaaattctctttaataccggatgatttaaaagctgctaaagaaagttggaatgatattcataaagatgcagaattcatttcaaaagacatcgcttttaaacaggaatag

SEQ ID NO: 269 - DNA, 1221 bp, Bacillus Sp.
atgaagaaatttccatttaaagtgttgactttggccactctggcaacggttatcactgctactaccggtaacactattcatgcatttgcacaagaaacgaccgctcaagaacaaaaagtagggaattatgaattagggcctgaagggctgaagaaagcattagctggaacaggatctcatattcttgtaatggatttgtacgcaaaaacaatgattaaacaaccaaatgtaaatttatccaatattgatttaggttcagaaggagcagaattaattaaaaatattcaccttaatcaggaactgtcacgaatcaatgcgaattattggttagatacagcgaagccgaaaattcaaaaaacagcacgtaatattgtaaattacgatgaacaatttaaaaattattacgatatattggaagctgctgtacaaaagaaagataaagcagagttaaaagagggcataaatgatttaatcactacaattaatacaaattcaaaagaagtcacagaagtaattaagatgttacaagacttcaaaacaaaactgtatgacaattctatagggtttaaaaataatgttggtggcccagatgggcaaggtggattaacggcactattagctggaaataatgcactgattccacaacttcaagctgaaattgagaagctacgttctactcagacagagcattttaacaatgtattagcatggtcaatcggtggtggattgggagcattcattttagttgctgcagccattggaggagcggtagtaattgttgtgactggcggtacagcaacaccagctgttgttggtggacttgcagctctcggtgcagctggtatcggtttaggaacagctgctggtgtcacggcgtctaagcatatggactcctataacgaaatttctaaaaaaatcggagaattaggtacgaaggccgatcttgctagccaagcagttatttcgcttactaacgcgaaagcaactttgacagatctgtatcaaacagtggatcaagcgatactgtctctaacaaatatccaacaacaatggaataaaatgggggccaactatacagatttacatgataatatcgactctatgcaagaacataaattctctttaatacttgatgatttaaaagctgctaaacaaagttggagtgatattcataaagatgcagaattcatttcgaaagacatcgcttttaaacaagaatag

SEQ ID NO: 270 - DNA, 1230 bp, Bacillus Sp.
atgaaaaaacttccatttaaagtgttagctgtagccactctagcaacacttataactactactaacggtaacactattcatgtacttgcacaagaacagaccgctcaagaacaaaaagtagggaattatgaattaggacctgaagggctgaagaaagcattagctgaaacaggatctcatattcttgtaatggatttgtacgcaaaaacaatgattaaacaaccaaatataaatttatccaatattgatttaggttcagaaggagcagaattaattaaaaatattcaccttaatcaggaactgtcacgaatcaatgcaaattattggttagatacagcgaagccgaagattcaaaaaacagcacgtaatattgtaaattacgatgaacaatttaaaaattattacgatatattggaagctgctgtacaaaagaaagataaagcagagctaaaagagggtttaaatgatttaatcactacaattaatacaaattcaaaagaagttacagaagtaattaagatgttacaagacttcaaaacaaaactgtatgacaattctacagggtttaaaaataatgttggtggtccagatggacaaggtggattaacggcactattagccggaaataatgccctgattccacaacttcaagctgaaattgagaagctacgttctactcagacagagcattttaacaatgtattagcatggtcaattggtggtggattgggagcattcattttagttgctgcagccatcgcaggaggagtagtaattgttgtgactggcggtacagcaacaccagctgttgttggtggccttgcagctctcggtgcagctggtatcggtttaggaacagcatctggtgtcacggcgtctaatcatatgaactcctataacgaaatttctaaaaaaatcggtgaactaagtacgaaagccgatcttgctagccaagcagttatttcgcttactaacgcgaaagcaactttgacagatttatatcaaacagtggatcaagcgataatgtctctaacaaatatccaacaacaatggaataaaatgggggctaattatacagatttacatgataatatcgactctatgcaagaacataaattctctttaatacttgatgatttaaaagctgctaaacaaagttggagtgatattcataaagatgcagaattcatttcgaaagacatcgcttttacacaagaagcaaagaattaa

SEQ ID NO: 271 - DNA, 1221 bp, Bacillus Sp.
atgaagaaatttccatttaaagtgttgactttggccactctggcaacggttatcactgctactaccggtaacactattcatgcatttgcacaagaaacgaccgctcaagaacaaaaagtagggaattatgaattagggtctgaagggctgaagaaagcattaactcaaacaggatctaatattcttgtaatggatttgtacgcaaaaacaatgattaaacaaccgaatgtaaatttatccggtattgatttaggttcagaaggagcagaattactcaaaagcattcaccttaatcaggaactgtcacgaattaatgcgaattattggttagatacagcgaagccgaagattcaaaaaacagcgcgtaatattgtaaattacgatgaacaatttaaaaattattacgatatattggcagctgctgtacaaaagaaagataaagcagagttaaaagatggaataaatgatttaatcactacaattaatacaaattcacaagaagtcacagaagtaattaagatgttacaagacttcaaaacaaaactgtatgacaattctatagggtttaaaaataatgttggtggcccagatgggcaaggtggattaacggcactattagctggaaataatgcactgattccacaacttcaagctgaaattgagaagctacgttctactcagacagagcattttaacaatgtattagcatggtcaattggtggtggattaggagcagccattttagttattgcagccattggaggagcggtagtaattgttgtgactggcggtacagcaacaccagctgttgttggtggacttgcagctctcggtgcagctggtatcggtttaggaacagctgctggtgtcacggcgtctaagcatatggactcctataacgaaatttctaaaaaaatcggagaattaggtacgaaagccgatcttgctagccaagcagttatttcgcttacgaacgcaaaagcaactttgacagatctgtatcaaacagtggatcaagcgatactgtctctaacaaatatccaacaacaatggaataaaatgggggccaattatacagatttacatgataatatcgactctatgcaagaacataaattctctttaatacttgatgatttaaaagctgctaaacaaagttggagtgatattcataaagatgcagaattcatttcgaaagatatcgcttttaaacaagaatag

SEQ ID NO: 272 - DNA, 1230 bp, Bacillus Sp.
atgaaaaaacttccatttaaggtgttagctgtagccactcttgcaacggttataactgctactaacggtaacactattcatgtacttgcacaggaacaaaccgctcaagaacaaaaagtagggaattatgaattagggcctgaagggctgaaaaaagcattagctcaaacaggatctaatattcttgtaatggatttgtacgcaaaaacaatgattaaacaaccgaatgtaaatttatccggtattgatttaggttcagaaggagcagaattactcaaaagcattcaccttaatcaggaactgtcacgaatcaatgcgaattattggttagacacagcgaagccgaaaattcaaaaaacagcacgtaatattgtaaattacgatgaagaatttaaaaattattacgatacattggcagctgctgtacaaaagaaagataaagcagagttaaaagatggattaaatgatttaatcactacaattaatacaaattcacaagaagttacagaagtaattaagatgttacaagacttcaaagcaaaactgtatgacaattctacagggtttaaaaataatgttggtggtccagatggacaaggtggattaacggcactattagccggaaataatgcactgattccacaacttcaagctgaaattgagaagctacgttctactcagacagagcattttaacaatgtattagcatggtcaattggcggtggattgggagcattcattttagttgctgcagccattgcaggaacagtagtaattgttgtgactggcggtacagcaacaccagctgttgttggtggtcttacggctctcggtgcagctggtatcggtttaggaacagcatctggtgtcattgcgtctaagaatatggactcctataacgcaatttctaacaaaatcggacaattaagtacgaaagctgatcttgctagccaagcagttatttcgcttactaacgcgaaggcaactttgacagatctgtatcaaacagtggatcaagcgatactgtctctaacaagtattcaacaacaatggaataaaatgggggcgaattatacagatttacatgataatgtcgactctatgcaagatcataaactttctttaatacttgatgatttaaaagctgctaaacaaagttggagtgatattcataaagatgcagaattcatttcaaaagacattgcttttacacaagaaacaaagaactaa

SEQ ID NO: 273 - DNA, 1221 bp, Bacillus Sp.
atgaaaaaacttccatttaaagtgttagctgtagccactctagcaacagttataactgctactaacggtaacactatgcatgtacttgcacaagaacagactgcccaagaacaaaaagtagggaattatgaattagggtctgaagggctgaagaaagcattaactcaaacaggatctaatattcttgtaatggatttgtacgcaaaaacaatgattaaacaaccgaatgtaaatttatccggtattgatttaggttcagaaggagcagaattactcaaaagcattcaccttaatcaggaactgtcacgaattaatgcgaattattggttagacacagcaaagccgaaaattcaaaaaacagcacgtaatattgtaaattacgatgaagaatttaaaaattattacgatacattggcagctgctgtacaaaagaaagataaagcagagttaaaagatggaataaatgatttaatcactacaattaatacaaattcacaagaagttacagaagtaattaagatgttacaagacttcaaagcaaaactgtatgacaattctacagggtttaaaaataatgttgatggacaaggtggattaacggcactattagccggaaataatgccctgattccacaacttcaagctgaaattgagaagctacgttctactcagacagagcattttaacaatgtattagcatggtcaattggtggtggattgggagcattcattttagttgctgcagccattgcaggaacggtagtaattgttgtgactggcggtacagcaacaccagctgttattggtggtcttacagctctcggtgcagctggtatcggtttaggaacagcatctggtgtcattgcgtctaagaatatggactcctataacgcaatttctaacaaaatcggacaattaagtacgaaagccgaccttgctagccaagcagttatttcgcttacgaacgcgaaagcaactttgacagatctatatcaaacagtggatcaagcgatactgtctctaacaaatatccaaaaacaatggaatacaatgggggccaattatacagatttacatgataatatcgactctatgcaagaacataaactttctttaatacttgatgatttaaaagctgctaaacaaagttggagtgatattcataaagatgcagaattcatttcgaaagacatcgcttttacacaagaaacaaagaactaa

SEQ ID NO: 274 - DNA, 1080 bp, Bacillus Sp.
atgaaaaaatttccattcaaagtactaactttagctacattagcaactgttataactgctactaccggtaacactattcatgcatttgcacaagaaacgaccgctcaagaacaaaaagtaggcaattatgcattaggccccgaaggactgaagaaagcattagctgaaacagggtctcatattctagtaatggatttatacgcaaaaacaatgattaagcaaccaaatgtaaatttatctaatatcgatttaggctcagaggggggagagttgctcaaaaatattcaccttaatcaagagctgtcacgaatcaatgcgaattactggttagatacagcgaagccacagattcaaaaaactgctcgtaatattgtaaattacgatgaacaatttcaaaattattacgacacattagtagaaactgtacaaaagaaagataaggcaggtctaaaagagggtataaatgatttaattactacaatcaatacaaattcaaaagaagttacagatgtgattaagatgctacaagacttcaaagggaaactatatcaaaattctacagattttaaaaataatgttggtggattgggagcagctattttagttattgcagctattggaggagcggtagttattgttgtaactggcggtacagcaacaccggctgttgttggtggactctcggctcttggtgcagctggtatcggtctaggaactgcggctggtgtcacagcatctaagcatatggactcctataatgaaatttctaataaaatcggagaattaagtatgaaagcagatcgtgctaatcaagcagttctttcgcttactaacgcgaaagaaacattggcatatttatatcagactgtagatcaagcgatattgtctctaacaaatattcaaaagcaatggaatacaatgggcgcaaattatacagatttactggataatatcgattctatgcaagaccacaaattctctttaataccagatgatttaaaagccgctaaagaaagttggaatgatattcataaagatgcagaattcatttcaaaagatattgcttttaaacaggagtag

SEQ ID NO: 275 - DNA, 1062 bp, Bacillus Sp.
ttggctgaaacagggtctcatattctagtaatggatttatacgcaaaaacaatgattaagcaaccaaatgtaaatttatctaatatcgatttaggctcagaggggggagagttgctcaaaaatattcaccttaatcaagagctgtcacgaatcaatgcgaattactggttagatacagcgaagccacagattcaaaaaactgctcgtaatattgtaaattacgatgaacaatttcaaaattattacgacacattagtagaaactgtacaaaagaaagataaggcaggtctaaaagagggcataaatgatttaattactacaatcaatacaaattcaaaagaagttacagatgtgattaagatgctacaagacttcaaagggaaactatatcaaaattctacagattttaaaaataatgttggtggtccagatgggaaaggtggattaactgcaatattagcaggtcaacaggcaaccattccacaacttcaagctgaaattgagcaacttcgttctactcagaaaaaacattttgatgatgtattagcatggtcaattggtggtggattgggagcagctattttagttattgcagctattggaggagcggtagttattgttgtaactggcggtacagcaacaccagctgttgttggtggactttcagctcttggagcagctggtatcggtctaggaactgcggctggtgttacagcatctaagcatatggactcctataacgaaatttctaacaaaatcggagaattaagtatgaaagcagatcgtgctaatcaagcagttctttcgcttactaacgcgaaagaaacattggcatatttatatcagactgtagatcaagcgatattgtctctaacaaatattcaaaagcaatggaatacaatgggcgcaaattatacggatttactggataatatcgattctatgcaagaccacaaattctctttaataccagatgatttaaaagctgctaaacaaagttggaatgatattcataaagatgcagaattcatttcaaaagatattgcttttaaacaggagtag

SEQ ID NO: 276 - DNA, 1032 bp, Bacillus Sp.
atggatttatacgcaaaaacaatgattaagcaaccaaatgtaaatttatctaatatcgatttaggctcagaggggggagagttgctcaaaaatattcaccttaatcaagagctgtcacgaatcaatgcgaattactggttagatacagcgaagccacagattcaaaaaactgctcgtaatattgtaaattacgatgaacaatttcaaaattattacgacacattagtagaaactgtacaaaagaaagataaggcaggtctaaaagagggtataaatgatttaattactacaatcaatacaaattcaaaagaagttacagatgtgattaagatgctacaagacttcaaagggaaactatatcaaaattctacagattttaaaaataatgttggtggtccagatgggaaaggtggattaactgcaatattagcaggtcaacaggcaacgattccacaacttcaagctgaaattgagcaacttcgttctactcagaaaaaacattttgatgatgtattagcatggtcaattggtggtggattgggagcagctattttagttattgcagctattggaggagcggtagttattgttgtaactggcggtacagcaacaccggctgttgttggtggactctcggctcttggcgcagctggtatcggtctaggaactgcggctggtgtcacagcatctaagcatatggattcctataatgaaatttctaacaaaatcggagaattaagtatgaaagcagatcgtgctaatcaagcagttctttcgcttactaacgcgaaagaaacattggcatatttataccagactgtagatcaagcgatattgtctctaacaaatattcaaaagcaatggaatacaatgggcgcaaattatacagatttattggataatatcgattctatgcaagaccacaaattctctttaataccagatgatttaaaagccgctaaagaaagttggaatgatattcataaagatgcagaattcatttcaaaagatattgcttttaaacaggagtag

SEQ ID NO: 277 - DNA, 1134 bp, Bacillus Sp.
gtgaataataattttccttataaactacttgctgtatcgacgtttttaaccctgacaacaactactgtagtttcaccagcagctgcttttgcaagtgaaagtaaaatagaacaaacgagtacggaagatatatctttttctgtaaacagtgaaaagatgaaaaaagctttgcaagatgctgggatatttgcaaaatccatgaatgattactcttatttgttaattaataacccaaatgttaactttgaaggaattgatattaaaggatatacaaatctacctagtcaaattgcacaagatcaaaagaatgcaagagagcatgctacaaaatgggatgcgcacataaaaaaacaacttttagatacccttacaggaattgtagagtatgataccacatttgacaattattacgatacattagtagaagcaattaatgaaggagatgcagatacattaaaagaaggcattacagatttacaaggtgagattaaacaaaaccaagcatatacacagaatttaatacaagaactagctaagttaagagatagtattggagaagatgtccgagcatttggaggtcataaagatatcttacaatcgattttaaaaaatcaagcatctggaatagatgaagatgaaaaacgcctaaatgatgttttagagcaagtaagacattttaaacaagtagaatcggatggaataataactgtatcagttccctcaattcctacatggattgctggtggtgtaatgattggggtagcaagagataatttagggacgttagagccgttattagcgcaattacgccaaacgatagactataaaataacactaaatcgtgtagttggggttgcgtataataatattgctgaaatgcaaaatgcaattggattagctattaatgctcttacttatatgtcagcacaatggcatgatttagattctcaatattcgggagtacttaatcatattgagaaagcatcccaaaaagcagatcaaaataaatttaaattcctaaaacctaatctgaatgcagggaaagatagttggaaaacattaagagcagatgcgtttacattaaaagaaggaataaaaacattaaaaatggatcctgtttcttccaaaaaatag

SEQ ID NO: 278 - DNA, 1134 bp, Bacillus Sp.
gtgaataataattttccttataaactacttgctgtatcgacgtttttaaccctgacaacaactactgtagtttcaccagtagctgcttttgcaagtgaaagtaaaatagaacaaaccagtacggaagatatatctctttctgtaaacagtgaaaagatgaaaaaagctttgcaagatgctggggtatttgcaaaatccatgaatgattactcttatttgttaattaataatccagatgttaactttgaaggaattgatattaaaggatatacaaatctacctagtcaaattgcacaagatcaaaagaatgcaagagagcatgctacaaaatgggatgcgcacataaaaaaacaacttttagatacccttacaggaattgtagagtatgataccacatttgacaattattacgatacattagtagaagcaattaatgaaggagatgcagatacattaaaagaaggcattacagatttacaaggtgagattaaacaaaaccaagcatatacacagaatttaatacaagaactagctaagttaagagatagtattggagaagatgtccgagcatttggaggtcataaagatatcttgcaatcgattttaaaaaatcaagcatctggaatagatgaagatgaaaaacgcctaaatgatgttttagagcaaataagacattttaaacaagtagaatcggatggaataataactgtatcatatccctcaatccctacatggattgctggaggtgtaatgataggggtagcaagaaataatttaggtacgttagagccgttattagtgcaattacggcaaacggtagactataaaataacattaaatcgtgtagttggggttgcgtataataatattgctgaaatgcaaaatgcaattggatcagctattaatgctcttacctatatgtcagcacaatggcatgatttagattctcaatattcaggagtacttaatcatattgataaagcatcccaaaaggcagatcaaaataaatttaaatttttaaaacctaacctgaatgcagcaaaagatagttggaaaacattaagagcagatgcatttacattaaaagaaggaataaaaacattaaaaatggatcctgtttcttcgaaaaaatag

SEQ ID NO: 279 - DNA, 1134 bp, Bacillus Sp.
gtgaataataattttccttataaactacttgctgtatcgacgtttttaaccctgacaacaactactgtagtttcaccagtagctgcttttgcaagtgaaagtaaaatagaacaaaccagtacggaagatatatctctttctgtaaacagtgaaaagatgaaaaaagctttgcaagatgctggggtatttgcaaaatccatgaatgattactcttatttgttaattaataatccagatgttaactttgaaggaattgatattaaaggatatacaaatctacctagtcaaattgcacaagatcaaaagaatgcaagagagcatgctacaaaatgggatgctcacataaaaaaacaacttttagatactcttacaggaattgtagagtatgatactacatttgacaattattacgatacattagtagaagcaattaatgaaggagatgcagatacattaaaagaaggcattacagatttacaaggtgagattaaacaaaaccaagcatatacacagaatttaattcaagaactagctaagttaagagatagtattggagaagatgtccgagcatttggaggtcataaagatatcttgcaatcgattttaaaaaatcaagcatctggaatagatgaagatgaaaaacgcctaaatgatgttttagagcaaataagacattttaaacaagtagaatcggatggaataataactgtatcatatccttcaatccctacatggattgctggaggtgtgatgataggggtagcaagaaataatttaggtacgttagagccgttattagtgcaattacgccaaaccgtagactataaaataacattaaatcgtgtagttggagttgcgtataataatattactgaaatgcaaaatgcaattggatcagctattaatgctcttacctatatgtcagcacaatggcatgatttagattctcaatattcaggagtgcttaatcatattgataaagcatcccaaaaagcagatcaaaataaatttaaattcttaaaacctaacctgaatgcagcgaaagatagttggaaaacattaagagcagatgcgtttacattaaaagaaggaataaaaacattaaaaatggaagctttttcttcaaaaaaatag

SEQ ID NO: 280 - DNA, 1134 bp, Bacillus Sp.
gtgaataataattttccatataaactacttgctgtatcgacgtttataactctgacaacaactactgtagtttctccagtagcagcttttgcaagtgaaagtaaaatagaacaaacgagtactcaagatatatctctttctgtaaacagcgaaaagatgaaaaaggctttgcaagatgctggggtatttgcaaaatccatgaatgattactcttatttgttaattaataatccagatgttaactttgaaggaattgatattaaaggatatacaaatctacctagacaaattctacaagatcaaaagaatgctagagagcatgcttcaaaatgggattcacacataaaaaaacaacttttagatacactgacggggattgtagagtatgatactaaattcgacaattattacgacacattagtagaagcgattaatgaaggagatgcagatacattaaaagaaggcattacagatttgcaaggtgagattaaacaaaatcaagcatatacacagaatttaatacaagaactagctaagttaagagatagtattggagaagatgtccgggcatttggaggtcataaagatatcttgcaatcaattttaaaaaaccaagcatctggaatagatgaagatgaaaaacgcctaaatgatgttttagagcaagtaagacattttaaacaagtagaatcggatggaataataactgtatcagttccctcaatccctacatggattgctggcggtattatgataggggtagcaagagataatttaggtacgttagagccgttattagcacaattacgtcagactatagattataaagtaacgttaaaccgtgtagttggtgttgcgtataataatattagtgaaatgcacgatgcaattggatcagctatcaatgctcttacctatatgtctgcacaatggcatgatttagattctcaatattcaggagtgcttagtcatattgataaagcgtcccaaaaagcagatcaaaataaatttaaattcttaaaacctaacctgaatgcagcgaaagacagttggaaaacgttaagagcagatgcgtttacattaaaagaaggaataaaaacattaaaaatgaatcctgtttcttcaaaaaaatag

SEQ ID NO: 281 - DNA, 1134 bp, Bacillus Sp.
atgaataaaaactttccttataaactacttgctgtatcgacgtttttaactctgacaacaactactgtagtttctccagtggcagccttcgcaagtgaaagtaaaatggaacaaactagtaccgaagatatatctctttctgtaaacagcgaaaagatgaaaaaagctttgcaagatgctggggtatttgcaaaatccatgaatgattactcttatttgttaattaaaaacccagatgttaactttgaaggcattgacattaaaggatatacaaatctacctagtcaaattctacaagatcaaaagaatgcaagagagcatgctacgaaatgggattcacacataaaaaaacaacttttagatacactgacggggattgtagagtatgatactaaattcgacaattattatgacacattagtagaagcgattaatgaaggggatgcagacacattaaaagaaggcatgacagatttacaaggtgagattaaacaaaatcaagcatatacacagaatttaatacaagaactaactaagttaagagatagtattggagaagatgtccgagcatttgcaggtcataaagatattttgcattcgattctgaaaaaccaagcatctggaattgatgaagatgaaaagcgcctaaatgaagttttagagcaagtaagacattttaaacaagtagaatcagatggaataataactgtatcaattccctcaattcctacgtggattgctggtggtgtaatgataggggttgcaagaaataatttaggtacgttagagccgttgttggcacaattacgtcagactatagattataaagtaacattaaatcgtgtagttggtgttgcgtataataatattaatgaaatgcacaatgcgattggatcggctattaatgcacttacctatatgtctgcacaatggcatgatttagattctcaatattcgggagtgcttagtcatattgataaagcatcccaaaaagcggatcaaaataaattcaaattcctaaaacctaatttgaatgcagcgaaagatagttggaaaacattgagagcggatgcgtttacattaaaagaagggataaaaacattaaaaatggatcctgtttcttcaaaaaaatag

SEQ ID NO: 282 - DNA, 1134 bp, Bacillus Sp.
atgaataaaaactttccctataaactacttgctgtatcgacgtttttaactctgacaacaactactgtagtttctccagtggcagccttcgcaagtgaaagtaaaatggaacaaactagtaccgaagatatatctctttctgtaaacagcgaaaagatgaaaaaagctttgcaagatgctggggtatttgcaaaatccatgaatgattactcttatttgttaattaaaaacccagatgttaactttgaaggaattgacattaaaggatatacaaatctacctagtcaaattctacaagatcaaaagaatgcaagagagcatgctactaaatgggatacgcacataaaaagacaacttttagatacgttgacgggtattgtggagtatgataccaagtttgacaattattacgatacactagtagaagccattgatgaaggagatggagatacattaaaagaaggaattacagatttacaagaagagattcaacaaaaccaagcgtatacacagaatttaatacaagaattagctaagttaagagatagtattggagaagatgtccgagcatttgcaggtcataaagatattttgcattcgattctgaaaaaccaagcatctggaattgatgaagatgaaaagcgcctaaatgaagttttagagcaagtaagacattttaaacaagtagaatcagatggaataataactgtatcaattccctcaattcctacgtggattgctggtggtgtaatgataggggtagcaagaaataatttaggtacgttagagccgttgttagcacaattacgtcagactatagattataaagtaacattaaatcgtgtagtcggtgttgcgtataataacattaatgaaatgcacaatgcaattgggtcggctattaatgctcttacttatatgtctgcacaatggcatgatttagattctcaatattcaggagtacttagtcatattgacaaagcgtcccaaaaagcggatcaaaataaattcaaattcctaaaacctaatttgaatgcagcgaaagatagttggaaaacattgagcgcggatgcgtttacattaaaagaaggggtaaaaacattaaaaatggatcctgtttcttcaaaaaaatag

SEQ ID NO: 283 - DNA, 1125 bp, Bacillus Sp.
gtgaataataattttccttataaattacttgctgtatcggcgtttttaactctgacaacagctactgtagtttctccagtagctgcatttgcaagtgaaagtaaaattgaacaaacgagtacggaaaatatatctctttctgtaaacagcgaaaagatgaaaaaagctttgcaagatgctgggggatttgcaaaatccatgaatgattactcttatttgttaattaataatccaggtgttaactttgaaggaattgatattaaaggatatacaaatctacctagtcaaattatacaagatcaaaagaaggcaagagagcatgctacaaaatgggatacgcacataaaaaaacaacttttagatacccttacaggaattgtagagtatgataccacatttgacaattattacgatacattagtaaaagcaattaatgaaggagatgcagatacattaaaagaaggcattacagatttacaaggtgatattaaacaaaaccaagcatatacacagaatttaatacaagaactagctaagttaagagatagtattggagaagatgtccgagcatttggaggtcataaagatatcttgcaatcgattttaaaaaatcaagcatctggaatagatgaagatgaaaaacgcctaaatgatgttttagagcaaataagacattttaaacaagtagaatcggatggaataataactacatatgtaccctcgattcctacatggattgctggtggtataatgataggggtagcaagaaataatttaagtacgttagaaccgctattagcgcagttgcgccaaacggtagactataaaattacattgaatcgtgtagttggagttgcgtataataatattgctgaaatgcagaatgcaattggatcagctattaatgctcttacctatatgtcagcacaatggcaggatttagattctcaatattcaggggtacttaatcatattgataaagcatcccaaaaagcagatcaagataaatttaaattcttaaaacctaacctgaatgcagcgaaagacagttggaaaacattaagagaagatgcgtctacattaaaggaagggataagaatattaaaagcttcttcaaaatcataa

SEQ ID NO: 284 - DNA, 1056 bp, Bacillus Sp.
gtgaataataattttccttataaactacttgctgtatcgacgtttttaaccctgacaacaactactgtagtttcaccagtaactgcttttgcaagtgaaagtaaaatagaacaaacgagtacggaagatatatctctttctgtaaacagcgaaaagatgaaaaaagctttgcaagatgctggggtatttgcaaaatccatgaatgattactcttatttgttaattaataatccagatgttaactttgaaggaattgatattaaaggatatacaaatctacctagtcaaatagcacaagatcaaaagaatgcaagagagcatgctacaaaatgggatgcgcacataaaaaaacaacttttagatacccttacaggaattgtagagtatgataccacatttgacaattattacgatgcattagtagaagcaattaatgaaggagatgcagatacattaaaagaaggcattacagatttacaaggtgagattaaacaaaaccaagcatatacacagaatttaatacaagaactagctaagttaagagatagtattggagaagatgtccgagcatttggaggtcataaagatatcttgcaatcgattttaaaaaatcaagcatctggaatagatgaagatgaaaaacgcctaaatgatgttttagagcaaataagacattttaaacaagtagaatcggatggaataataactgtatcatatccctcaatccctacatggattgctggaggtgtaatgataggggtagcaagaaataatttaggtacgttagagccgttattagctcaattacgccaaacggttgactataaaataacattaaatcgtgtagttggggttgcgtataataatattgctgaaatgcaaaatgcaattggatcagctattaatgctcttacctatatgtcagcacaatggcatgatttagattctcaatattcaggagtacttaatcatattgataaagcatcccaaaaggcagatcaaaataaatttaaatttttaaaacctaacctgaatgcagcaaaagtgcgcccataa

SEQ ID NO: 285 - DNA, 1056 bp, Bacillus Sp.
gtggcagccttcgcaagtgaaagtaaaatggaacaaactagtaccgaagatatatctctttctgtaaacagcgaaaagatgaaaaaagctttgcaagatgctggggtattcgcaaaatccatgaatgactattcttatttattgattaataacccagatgttaactttgaaggaattgatattaaagggtatacaaatctacctagtcaaattctacaagatcaaaaaaatgcaagagagcatgcaactaaatgggataagcacataaaaagacaacttttagatacgttgacgggtattgtggagtatgataccaagtttgacaattattacgatacactagtagaagccattgatgaaggagatggagatacattaaaagaaggaattacagatttacaagaagagattaaacaaaaccaagcgtatacacagaatttaatacaagaattagctaagttaagagatagtattggagaagatgtccgagcatttgcaggtcataaagatatattgcattcgattctgaaaaaccaagcatctggaattgatgaagatgaaaagcgcctaaatgaagttttagagcaagtaagacattttaaacaagtagagtcagatggaataataactgtatcaattccctcaattcctacgtggattgctggtggtgtaatgataggggtagcaagaaataatttaggtacgttagagccgttgttagcacaattacgtcagactatagattataaagtaacattaaatcgtgtagttggtgttgcgtataataatattaatgaaatgcacaatacgattggatcggctattaatgcacttacctatatgtctgcacaatggcatgatttagattctcaatattcgggagtgcttagtcatattgataaagcatcccaaaaagcggatcaaaataaattcaaattcctaaaacctaatttgaatgcagcgaaagatagttggaaaacattaagagcagatgcgtttacattaaaagaagggataaaaacattaaaaatggatcctgtatcttcaaaaaaatag

SEQ ID NO: 286 - DNA, 1143 bp, Bacillus Sp.
gtgaaaaaaaaaatcccttgtaaactacttgctgtatcgacgtttttcacactgacaacaacgcctgtagtttccccagtagctgcttttgcaagtgaaagtgaaaataaagtagaacaaataagtactaaagatatgtctctttctgtaaacaatgaaaagatgaaaaaggctttgcaagatgctggggtatttgcaaagtccatgaatgattactcttatttgttaattaataatcctgatgttaactttgaaggaattgatattaaaggatatgcaaatctacctagtcaaattatacaagatcaaaaaaaggcaagagagcatgctacaaaatgggattcacacataaaaaaacaacttttagatacactaacggggattgtagagtatgatactaaattcgacaattattatgacacattagtagaagcgattaatgaaggggatgcagatacattaaaagaaggtattacagatttacaaggtgagattaaacaaaatcaagtatatacaaaaaaattaatacaagaattagctaagttaagagatagtattggagaagatgtccgaacatttgccggtcataaagatatcttgcaatctattttaaaaaatcaagcatctggaatagatgaggatcaaaaacgcctagatgatatttcagagcaaataagacattttaaacaagtagaatcggatggaataataactgtaatattcccttcaccttttacatggatttctggtggtataatgataggggtagcaagagataatttaggtacattagagccgttattagcacaattacgtcaaactatagattataaagtaacgctaaatcgtgtagttggtgttgcgtataataatattaatggaatgcacgatgctattggatcagccattaatgctcttacctatatgtcagcacaatggcatgatttagattctcaatattcaggagtacttaatcatattgataaagcatcccaaaaggcagatcaaaataaatttaaatttttaaaacctaacctaaatgcagcgaaagatagttggaaaacattaaaaacagatgcatttactttaaaagaaggaataaagatattaaagatatcttctaaaaataaagcacaagtataa

SEQ ID NO: 287 - DNA, 978 bp, Bacillus Sp.
atgaaaaaagctttgcaagatgctggggtatttgcaaaatccatgaatgattactcttatttgttaattaataatccagatgttaactttgaaggaattgatattaaaggatatacaaatctacctagtcaaattgcacaagatcaaaagaatgcaagagagcatgctacaaagtgggatgcgcacataaaaaaacaacttttagatactcttacaggaattgtagagtatgatactacatttgacaattattacgatacattagtagaagcaattaatgaaggagatgcagatacattaaaagaaggcattacagatttacaaggtgagattaaaaaaaaccaagcatatacaaagaatttaatacaagaactagctaagttaagagatagtattggagaagatgtccgagcatttggaggtcataaagatatcttgcaatcgattttaaaaaatcaagcatctggaatagatgaagatgaaaaacgtctaaatgatgttttagagcaagtaagacattttaaacaagtagaatcggatggaataataactgtatcagttccctcaatccctacatggattgctggaggtgtaatgataggggtagcaagaaataatttaagtacgctggaaccgctattagcgcaattgcgccaaacggtagactataaaattacattgaatcgtgtagttggagttgcgtataataatattgctgaaatgcaaaatgcaattggatcagctattaatgctctcacctatatgtcagcacaatggcatgatttagattctcaatattcaggagtacttaatcatattgataaagcatcccaaaaagcagatcaaaataaatttaaattcttaaaacctaatctgaatgcagccaaagacagctggaaaacattaagagcagatgcgtttacattaaaagaaggaataaaaacattaaaaatggatcctgtttcttcaaagaaatag

SEQ ID NO: 288 - DNA, 1128 bp, Bacillus Sp.
atgatgaacaaaatcccttataaactactcgctgtatcgacgtttttaacgttgacaacaacatctgtcgtttcaccagtagcaacttatgcaagtgaaattgaacaaactaacaatggagatacggctctttctgcaaatgaagcgaggatgaaagaaaccttgcaaaaggccgggttatttgcaaaatctatgaatgcctattcttatatgttaattaaaaatccagatgtgaactttgaaggaattactattaatggatatgtggatttacctggtagaattgtacaagatcaaaagaatgcaagagcacatgctgttacatgggatacgaaagtaaagaaacagcttttagatacattgacgggcattgttgaatacgacacaacatttgacaattattatgaaacaatggtagatgcaattaatacaggggatggagatactttaaaagaagggattacagatttacgaggtgaaattcaacaaaatcaaaaggttgcacaacaattaatagaagaattaactaaattaagagactatattggacaagatgttagagcatttggaagcaataaagatctcttgcagtcgattttaaaaaaccaaggtgtagatgttgaggccgatcaaaagcgtctagatgaagttttaggatcagtaaactattataaacaattagaatctgatgggtttaatgtaatgaagggtgccattttgggcctaccgataatcggcggtatcatagtgggtgtagcaagagataatttaggtaagttagagcctttattagcacaattgcgtcagactgtagattataaagtaacattaaatcgtgtagttggagttgcttacaataatattagtgaaatgcataaggcgcttgatgatgctattaatgctcttacttatatgtccacgcaatggcatgatttagattctcaatattcgggagtactggggcatattgaaaatgcagctcaaaaagcggatcaaaataaatttaaattcttaaaacctaacttgaatgcagctaaagacagttggaaaacattacgaacagatgctgtcacattaaaagaagggataaaagaattaaaagtggaacctgtcactccacaaaaatag

SEQ ID NO: 289 - DNA, 1128 bp, Bacillus Sp.
atgatcaaaaaaatcccttacaaactactcgctgtatcgacgtttttaactttgacaacaactactgtagtctcaccagtagcagcttttgcaagtggaattgaacaaaccaacaatggagatatgtctctttcagcaaatgaagtaaagatgaaagaaaccttgaaaaaggctgggttatttgcaaaatctatgaatgcctattcttatatgttaattaaaaatccagatgttaactttgaaggaattactattaatggatatgtggatttacctggtagaattgtacaagatcaaaagaatgcaagagcacatgctgttacatgggatacgcaagtgaaaagacagcttttagatacgttgactggcattgtcgaatacgatacaaaatttgataactattatgaaacaatggtagatgcgattaatacaggggatggagatactttaaaagaagggattacagatttacgaggtgaaattcaacaaaatcaaaaggttgcacaacaattaatagaagaattaactaaattaagagactctattggacaagatgttagagcctttggaagtaataaagatctcttgcagtcgattttaaaaaaccaaggtgcagatgttgaggccgatcaaaagcgtctagatgaagttctaggatcagtaaactattataaacaattagaatctgatgggtttgatgtaatgaagggtgccattttgggcctaccaataatcggcggtatcatagtaggtgtagcaagagataatttaggccagttagagcctttattagcagaattacgtcagacagtagattataaactaacattacatcgtgtagttggagttgcttacaataatattagtgaaatgcataaggcgcttgatgatgctattaatgctcttacatatatgtccacgcaatggcatgatttagattctcaatattcgggagtactggggcatattgaaaatttagctcaaaaagcggatcaaaataaatttaaattcttaaaacctaacttgaatgcagctaaagacagttggaaaacattacgaacagatgctgtcacattaaaagaagggataaaagaattaaaagtggaacctgttaatccacaaaaatag

SEQ ID NO: 290 - DNA, 933 bp, Photorhabdus Sp.
atgttcaaaaatgatattcgcgaaaaagcagttacatctggtaaaagcaaaacttcgaatgaagggttgttggatgcattacatttggaattacctgatgtaaaagcagttatgtcagcttataagaaacagactcctgaatttggtgattttaatagaaaaacgcgattaattctcaatgcttcgcaagagtttgggcaattgaaacctgcaaagcagcgtaagttttctaaaccgggtttaaaaaaggatggtgtttctgatggaaatttcatttattcaaaaaaatctctgcaagatttcgctgctcatgcaggatatgtgcataatggtgattatgacgatgaatttgttaattttaaggataatgatagaaatttagcgaatggaagattattcccgggtattagcttgattaaacgtccgaaattatcaatagtaaaagataaagaagcatggaaaatgcaacaaagtgacgaggcagaagcttataaggttactgatattgaagcctttatttcagggataagagagatgtatggtgaggaaaatcctttgcatccagtaatagaatctttgatcagaaatcatattattaataatcactatgtattaccgacgatggcaggtattgctggtttgcacgcagaggtacaggcactgaataatttattaactttagaagatgaaagggaagggaaagctgttggaagtcggaaaataggggaatatatgcgggatatgttgcaatcatctatttttactcagcggttaacaacaaaacaatctggagatgattttgccgcttgtcataattgttcggggatattgtcatcaccggtcaatgttattacaggaaaagtgcaaagtgcaggaagtaatttttcatcaacattatctcgatataaaaaatcgcaagaatcaccgatataa

SEQ ID NO: 291 - DNA, 933 bp, Photorhabdus Sp.
atgttcaagaatgatattcgcgaaaaagcagttaaatttggtaaaagtaaagctccaaatgaaggattgttggacgcattacatttggaattacctaatgtaaaagcagttatgtcagcttataagaaacagactcctgaatttggtgattttaagagtaaaacgcgattaattctcaatgcttcgcaagagtttgggcaattgaaacctgcaaagcagcgtaaattctctaaaccgggtttaaaaaaggatggtgtttctggtggaaattttatttattcaaaaaaatctctgcaagatttcgctgctcatgcaggatatgtgcataatggcgattatgacgatgaatttgtcaattttaaggataatgatagaaacttagcgtatggaagattattcccgggtattagcttgattaaacgtccgaaattatcaatagtaaaagataaagaagaatggaaaatgcaacaaagtgacgaggccgaagcttataagatcactgatattgaagcctttatttcagggataagagagatgtatggtaaggaaaaccctttgcaccctgtagtagaatctttgatcagaaatcatattattaataatcaatatatattaccgacgatggcgggtattgctggtttgcatgcagaggtacaagcactgaataatttattgactttagaagatgaaagggcagggaaagctgttggaagtcggaaaataggggagtatatgcgggatatgttgaaatcatctatttttactcagcggttgacaacaaaacaagctggagatgattttgccgcttgccataactgttcggggatactgtcatcgccagtcaatgttattaccggcaaagtggaaagtgcgggaagtgatttttcatcaacatggtctcgatataaaaaatcgcaggaatcaccaatataa

SEQ ID NO: 292 - DNA, 933 bp, Photorhabdus Sp.
atgttcaagaatgatattcgcgaaaaaacagttaaatttggtaaaagtaaagctccaaatgaaggattgttggacgcattacatttggaattacctgatgtaaaagcagttatgttagcttataagaaacagactcctgaatttggtgattttaagagtaaaacgcgattaattctcaatgcttcgcaagagtttgggcaattgaaacctgcaaagcagcgtaaattctctaaaccgggtttaaaaaaggatggtgtttctggtgtaaattttatttattcaaaaaaatctctgcaagatttcgctgctcatgcaggatatgtgcataatggcgattatgacgatgaatttgtcaattttaaggataatgatagaaacttagcgtatggaagattattcccgggtattagcttgattaaacgtccgaaattatcaatagtaaaagataaagaagaatggaaaatgcaacaaagtgacgaggccgaagcttataagatcactgatattgaagcctttatttcagggataagagagatgtatggtaaggaaaatcctttgcaccctgtagtagaatctttgatcagaaatcatattattaataatcaatatatattaccgacgatggcgggtattgcgggtttgcatgcagagatacaagcactgaataatttattgactttagaagatgaaagggaagggaaagctgttggaagtcggaaaataggggaatatatgcgggatatgttgcaatcatctatttttactcagcggttaacaacaaaacaagctggagatgattttgacgcttgtcataactgttcggggatattgtcatcaccggtcaatgttattacaggaaaagtgcaaagtgcaggaagtaatttttcatcaacattatctcgatataaaaaatcacaggaatcaccaatataa

SEQ ID NO: 293 - DNA, 933 bp, Photorhabdus Sp.
atgttcaaaaatgatgtttatgaaaaaacagttaaatctggcaaaggtaaaacttcagatggaatgctattggatgcattatatttggatatccctaatgccagagcagtcatgtctgcttataagaaaaagacgcctaatttacctgacttcaatgaaaagacgcaattaattctcagtgcttcaaagaaatttggtcagctaaaacctgcaaagcaacgtgctttctctgagcctggtttaaaagcgaatggtgtttctgacggaaaatttatttattcaaaaaactctttgtcgaatttcgctgctcatgcaggatatgagcataatggtcattatgacgatgagtttgtcaattttaaggataatgatagaaatttagcagagggtaagctatttcctggaattaacttgattaggaggccattaatagaaaaaaacaaagaaacaaatgaatgggaaataaaacaaatagaggtgggtgcttataaggttagtgatattgattcttttattttagggataaataatatgtatagtgaagcaggtacatctttacatccaataatagaatccctgatcagaaatcatattattaacaatgattatgtattacctacgatggcaggtattgctggtttgcatgcagaggtacaagcacttaaccatttattgattttagaagataaaagggccgggaaaactattggaagtcgaaaaataggcgaatatatgcgggatatgctgaaatcatctatttttacacagcgattaacaacaatacaagcgggagatgattttgctgcttgccataattgttctggaatattgtcagcgccagctaatgttattactggtaaggtggaaagtgcgggcaataatttttcatcgacattatctcgatataagagatcacaagaatcaccaatataa

SEQ ID NO: 294 - DNA, 948 bp, Photorhabdus Sp.
atgtttaaaaataatattcgtgaaaaagcaattaaaaaattgcatttcaaagataaaaatccagatatcactagattagacggattacacttggaacttcctgataataaggcggtaacatcagcttatcaacaacatatccctgagttaaaagattttagtaaaaaaacacaattaatcctcaatgcctcaaaagaatttggacaactgaaaccagcgaagcaacgtagcttttctaaagctggcctaaaagccgatggtatttctgatggacgatttacctatgcaaaaaaatctttggaaaatttcgctgcccatgcgggatatgagcatcatggtcactatgacgatgaatttgtcaatcttaagaataatgaaaaaaatttagcagatgggaagttattccctggcattaatctaattaaacgccagaaattatcaaaagtaaaaaatgaaaaaaccaaaaaatgggaaacacaattaagagatgaagcggaagcttataaggtcaataatattgaatcctttatctcagaaataaaagatatgtataagcaagcaaataaacctttacatccaataaccgaatccctgatcagagatcatattgctaacaacgaaggcgtattacccacaatggcgggtattgccggtttacatgcagaggtgcaagcccttaacaatttattgatcttagcggatgaaagagcaggaaaaccgattggcagccgcaagataggagaatatatgcgggatatgctggaatcatccatctttacccaacgactgacaaccaaacaagctggagatgattttgctgcttgccataattgctctggaatattatcaacaccagccaacgttataacgggtaaggtagccagtgcaggaagtaatttctcactaacattagctcaatacaaagcatcgcaagaatcgccaatttaa

SEQ ID NO: 295 - DNA, 948 bp, Photorhabdus Sp.
atgttcaaaaatgatattcgtaaaaaaacaattaaaaaagctcattccaaaaataaaaactcagatacgactctattagatagattacatctggaaattcctgataccaacgcggtaacaacggcttatcaacaacagatccctgaattgaaagactttagtaaaataacacaattaatcctcagcgcctcaaaagaatttgggcaattaaaaccggcaaagcagcgcaattattctaaaccgggtctaaaagacgatggtatttctgatggacgatttgcttatgggaaaaaatctttggaaaattatgcggctcatgcaggatatgaacataatggtcgctatgaagatgaatttgtcaatttcaagaataatgataaaaatttagctgacggaaaactctttccgggtattagcctgattaaacatccgaagctattaagagtaaaaaatgaaaaaacaaaaaaaccggaaacacaactcagagaggaagccgaagcttatcaaatcaccgacattgaatcttttatttcagggataaaagagatgtataaccaagcaaacaaacctttacatccgataactgagtccttgattagagagcatattattaataatgaaggtgtattaccgacaatggcgggtattgcaggcttacatgcagaagtacaagcacttaacaacttattcatttccggggataagagagcgggaaaatctattggcagccgcaatctaggggaatacattcgggatatgttggaatcctctatctttacacagcgactgacaacaaaacaagccggtgatgattttgcggcttgtcataattgttctggaatattgtcatcaccagtcaatgttattacagggaaagtagcgagttcaggaagtaatttctcattagcattatctcgatataaaacatcacaagaatcgccaatataa

SEQ ID NO: 296 - DNA, 5727 bp, Xenorhabdus Sp.
atggataaatttaacagcccggtggcaaggggaacctgttattttttgatttacctgacaggcatatatccgctgaactcagcaatcgcaggcggtattacccctgacaatccgaagacacaggtacacaacaatggcaatgtgcctgtagtgaatattgctgcgcccaataatgccggaatatctcacaatacttataaagaatttaatactggtattcagggcgccatattaaataacgccacccaggcggttaaatctcaactggccggtcaaatcagtgccaatgccaatctgcatggaaaagcggccgaacttatcatcaacgaagtcaccggcagcagccgttctgaactgctggggcaactggaagtggccggtcagaaagccaacgtcatgatagccaacccaaatggcattacctgtgacggatgtggatttattaatacctcaggtgcaataataacgacgggtaaaccgcaatttgataaacagggtgcactggaagccctgaaagtgacaaaaggccaaatcacgattgggggtaaagggttaaatggtcagtcaaccgattatgtcgatattatcagccgggcgacagagctgaatggaaaaattcaggccaagaatcttgcactgactcagggggctaatcagatttccttcaaagacggcacggcaaagaccattgccggagaagggaaccgtccacaattatctgtcgataccaaagcgctgggcgggatgtatgccaataaaatccgtctggttgccacggaaaatggggttggggtcaacctgaaaaatatcaccagccatcagcaggatattacgcttagttcaaatggcaaaatggaactgggcaatattaaggctaaaaccgacttaaatgccggggctaaagaaattaatattggaccgaattctcccgttcaggccggacgggatatcgttcttgccagcagcaaagtgagtaataaaggcagtgtgactgccgggcaagatatgcggatttatggtgacactatcagcaatgcaggggcgcaagcactgctacaagccaataacaatatgtggatccaaaaaaatgcagaaggggacaaaaacgagttagttgaaaataagtccggtaccataaaaacaaacagtggtgacttaatcatcagaactcaaaacctagttaatgagaaagaaaatgtacaagtcactaaaacaaaccatcaaataaattctaatgctggctatggagattaccctaaattcaaatttgatttgaataaacccattcttatcgataatcgccataaagatattaaactagaacatgctgattttgtatcaaatgttgatagcaaaccggcggttattgaatcaggtcatgatgcttatttatatggggaaaatttaaccaacaaaaatagtaatatctcggcaaaaaataatttaatcctgacaggaacacatttaaaaaacagtggaatttcttttggattattagagaagtataaagaagattttcgttcggaagatagaaaaaatattttaaacagagatattttaatatggaataataatagtgtttttcaatcaatattaagtgctaaaaatagtttggttgctgattttaaagaatcaatatctataaaaaatgaattaccgagtgaagctaacaatattaatcaaataatttatggtaataattatatagctttaaatgcaaaaaacattttgctgcatgctaaagatgtctatctttcaaatgaaacaaaagcagataaggatgtgagtatcattgctgataactcagttaaaacatcattagctgtgttaaatgctggagaaaatatatctgtcgcagcgcgttatgatattaatttattagacagcaatttaaaaagtaaaaatatctccttaatcagtaatgatggtaacgtaaatgtaaaaaattctttacgcgctttttatccagataatactcgtttattgagtaaattagatgcttctgccgatttaagtatttcagccggaaaagatatttatattaaagatacattgtttgtatctaaaagtaaaaacatcgcattcaatgcaaataaagatattaccattgagcacactgatgatttattaaaccaccataacccaattcaacaactttcaactgaccaggaagcaaaattatttgatagtttatcccctactgcaaaattagattcatcaggatctattttaatcaacagtggtggaaacctgtctttaaacagagtgaatttagacgctgacaaagatattgacctatatgctggctacaatatcaatcaatattcaaaagaatttgaaccaaaccatttcagagtttccacggtcactaaagcacctaaacttcaaactcatattaaatccgggaataatctattaattaatgcacaacatgatatcaccttagaaggtttagatagttccactcaaggttcaacaaatctattagccggaaattcaataaacttattaggcattccttatttttttgagaataatggattagaggtcttaagatattcagctcctattaattttccaccaaataacaatattgttacaattcttaaagcgaataaagatattaatctagtatctggtggtgagattttaactgaaggttcaacattatcagcaaatggcaatattgtagtctcttcagaaaagaatatgaatttcgagtcgatcgctatttataaaagtaattccaaagatggctataggattgaaaaaataaccaatgaactctctgagttaacggccggaggtatcttaaaactagttactaatgggagtatcttatttgaagcaaccaaattgactgctaaaggattaggagctgtttggaaagatcctattcaattgtcagattggagtaattcattaatttctattgaaaataaaataaaagaagatgaacaaaaattatatgttcaacaacaaaacagagtacctttacagaaaaaatcaaatgaactaaatgtgcagattaaacatcttgaagatactcttgaaaaacagagaaaaatgttcagtgacgtgtccatccctgctgatgtaacatctaaaatattagctacgacaataccttttaaaaaattgaacaaatataaagaagaattaaccccaataacgaataaattaagtcagatagataaccagattagctttttaagtaatgttttaacgacggaaaaaaatcaattggctaaaactattcaggagcttaaaaataaaggtatagatgaagctaaacaacaagccgaaatagatgctcataataaatcagaagccatgcgtatcggcactatcgatgtggcagctaaaggcgggtatttatacgccaaagcacaacagaattcagaaaaacgtgaaataacccgaaaaagctcaagtggtggtttctttgggggcactaaaacaacgactgaaattagtcacaaaacgggtcatgacgtcggcgaatttattgctgccggcaatattactatgctcagtcatgatgacagtacgtatgaagcgagtaaaatagaagccggtaaaaatattcgccttattagtacacatggtaaagttaattttaccgccatgccaaatacgtcgtttgagcaaataaccagtagctcgaaaggtttattcatcaaacaatctaatagtggacataataataccacctggacattaccagcgatatcttcggggagcttatttactgtcgaggctaattcaggcattaacgctgatattaaaacacagaaaagccaatctctgaaaacggcattgaacattcttggcgaaaatccagaagcagcctggttaaaagatttaaacaaccgacatgatgtaaaatggaatgaagttcaggatgcgtattctaattgggattatagtcatcaacaattaagcccagtagcctctgcggttatagccatagcagtagcggcagtgacagcaggatcgggtttagctgtttcggctggcgcatcaacagcgtctacagcgacgggagtgggtacagcgacggccgcaacagcaacgactacaggtgcttttgtttccggcgcaaccattgccggtatctcatctttagcttctaaagcagcagtgaccctggttaataatcaaggaaacttatctaaaacgtttagagagctaggcaatagtgatacggtaaaatcaaccattacttccatggccattggtggtgcattggccggattcgatcaagccatgggctggagtgcggcgaaagatggggctaacgctgttgcttcatcaacccactcaaatatcccgctattaagtaaaggtgcagattggagcaaagtcgcccaacgtgttgctggacaatccattatcagctccagtttaaataccaccattaatggaggcagctttaaagataatttcgctacagcattgcttgctagtgctggaaatcaaattaatgcggaaggggcaaatgttatcggagactatggcaaagtactcggtactcctggcaaggccattagtcatgctgcagtatcggctattgccgcacacattggtggaggagatgccagaggcgcagccgctggcgcactcgccgctgaacttggtgcgctgacactggctaagacatttaatgatcccgcacaaattctggccggtggcaaaatcatcggtggtattgccggtgcatttgctacaaacagtgcacaaggcgctaacagtggtgcaaatgccagtgaaatcgttcttgaacataatttctttgcacatgagttgattgaattagatgaagcaatcaaagcagcaaagaaaaaaggagaaaacactgctcctatctttgaaagaacgcgcaataaactggcagaacagcgagaatctgtcaaagccgagtgtcaggccaatccgactatgtgtgctgttacacttagcgaatatgccaatcaggcactggaatccgtcgagacctttatcggcagactgtattttgataacagtgtgattgcgttcacacatgaagaatcggctaaagataatgccgtcattgaagattataccaatggcgctgggcaggtactggcgtatgcccttaacggtgcgaaatttctgagtggcgaagacactaaattttcgatgaccggaaaaagcatcaggacgcggatccacaatcaacaggccaatcagtcggggtcctcaccagaggtcgttgtaataaacacaaactcaggtaaaaagaggggttggactacagaactgaataaacctcaaccaaataccctttaccatgtggatggaaataaaacgttccaaactgattcgctaggccgtactatccttgctgaaggcactctgtctttgtctaaaaaagatcgtaatacttatcaacagtgcaaagcagggaaatgtggtaatccaggagatgaaggtggtcatctatttgccagtatctttaatggcccgggtgagaaaataaatattctcccaatgaatggaaatctgaataaaggtgaatggaaaaagatggagaattcatgggctaatgctcaaaaagacggcaaacaagttcatgttaaaattgtacctgtctataatagcaacaataatagtggacgcccagataaatacaatgtcaaatattctatcgatggagagaggccagtgatcgttaactttaataattctgagggcggaaaatag

SEQ ID NO: 297 - DNA, 1464 bp, custom Sp.
atgtctaccgaccagcagtctgcgctgcagggtcagccgctgaacggtgcgtctgaaccgatcatctctgcgcagttcaaatacgaaatcgactacaacaacgcggcgcgtgttgttatcaccaccggtctggaccagatcccgatggttggtttcgttctgggtgcgctggttgaaatcttctggccgtcttctcagcaggacgtttggtctgaaatcgaagcgaaagttgaacagctggttgacgcgaaaatctctgaactggtttaccagcaggttcaggaatctctggcgggtctgcacaacaacctgaacgaatacctgtgggcggttaaaaacaccaaagacccgaactacatcacccagaaattcaacatcgcgcacggtcacttcatccaggaactgccgcacttccagtctaaaggttacgaactgctgctgctgccgctgttcgcgcagttcgcgaacctgcacctgtctctgctgcgtgacggtgttatctacggtgcgtcttggggttggggtgaagacgttcagcgtcacctgcgtgaacagatcgttgaaaccatccagcagtacgttcagtacaccgacaccacctacaccgaaggtctgcagaacacccagtctaaagcgccgtctaactctcactacaccgaaccgttcaacaccgttaaccagtacatccgtgaaatgaccctgaccgttctggacttcaaaaccatgtggccgtactacgacccgacccagtacccgaacccggttaaaatctacctggaccgtgaaatctactctgacgcggttggtaccgcggacaactctggtccgatcaccctgccgtctccgccgaccaaagcgatcaccaaaatcgaagtttgggcgtgggaccgtatcgacggttgccaggttacctacgaacagggtggtggtccgaacggtgttacccagaccccgcgtatgggtgaccagggtggtggttcttcttctccgccgcacggtggtgttttcgacctggttacccgtggtccggttgttggtgttaaaaccctgtctggttctatcctgaacgcgtggtggttcaccttcgacgacggttctacctctaaccagctgggtggtaactacccgggtggttctgaccactctttctcttacccggacgaaatcctgtcttctatcaaaatcatgggtgtttctaactactacaaatctgcggactgcgcggttttcggtttcaaattcaaacaggaacagtctctgccggaaccggcgctgctgcgtaccatgtacgttgcgtctccggcgaaaatctctccggaagaactggcgcgttgcgttggtgcggaagacatcgacaaaaccggtaaactgatccaggaatggtctgacttctaccactgggacaccatccgtcagtctcactgggaccgtatccagaccgttgttgactctcagggtaaataa

SEQ ID NO: 298 - DNA, 1467 bp, custom Sp.
atgatgtctaccgaccagcagtctgcgctgcagggtcagccgctgaacggtgcgtctgaaccgatcatctctgcgcagttcaaatacgaaatcgactacaacaacgcggcgcgtgttgttatcaccaccggtctggaccagatcccgatggttggtttcgttctgggtgcgctggttgaaatcttctggccgtcttctcagcaggacgtttggtctgaaatcgaagcgaaagttgaacagctggttgacgcgaaaatctctgaactggtttaccagcaggttcaggaatctctggcgggtctgcacaacaacctgaacgaatacctgtgggcggttaaaaacaccaaagacccgaactacatcacccagaaattcaacatcgcgcacggtcacttcatccaggaactgccgcacttccagtctaaaggttacgaactgctgctgctgccgctgttcgcgcagttcgcgaacctgcacctgtctctgctgcgtgacggtgttatctacggtgcgtcttggggttggggtgaagacgttcagcgtcacctgcgtgaacagatcgttgaaaccatccagcagtacgttcagtacaccgacaccacctacaccgaaggtctgcagaacacccagtctaaagcgccgtctaactctcactacaccgaaccgttcaacaccgttaaccagtacatccgtgaaatgaccctgaccgttctggacttcaaaaccatgtggccgtactacgacccgacccagtacccgaacccggttaaaatccagctgacccgtgaaatctactctgacgcggttggtaccgcggacaactctggtccgatcaccctgccgtctccgccgaccaaagcgatcaccaaaatcgaagtttgggcgtgggaccgtatcgacggttgccaggttacctacgaacagggtggtggtccgaacggtgttacccagaccccgcgtatgggtgaccagggtggtggttcttcttctccgccgcacggtggtgttttcgacctggttacccgtggtccggttgttggtgttaaaaccctgtctggttctatcctgaacgcgtggtggttcaccttcgacgacggttctacctctaaccagctgggtggtaactacccgggtggttctgaccactctttctcttacccggacgaaatcctgtcttctatcaaaatcatgggtgtttctaactactacaaatctgcggactgcgcggttttcggtttcaaattcaaacaggaacagtctctgccggaaccggcgctgctgcgtaccatgtacgttgcgtctccggcgaaaatctctccggaagaactggcgcgttgcgttggtgcggaagacatcgacaaaaccggtaaactgatccaggaatggtctgacttctaccactgggacaccatccgtcagtctcactgggaccgtatccagaccgttgttgactctcagggtaaataa

SEQ ID NO: 299 - DNA, 1293 bp, custom Sp.
atgtctgaccagtctgcgctgcagggtcagccgctgaacggtgaaccgatcatctctgcgcagttcaaatacgaaatcgactacaacaacgcggcgcgtgttgttatcaccaccggtctggaccagatcccgatggttggtttcgttctgggtgcgctggttgaaatcttctggccgtcttctcagcaggacgtttggtctgaaatcgaagcgaaagttgaacagctggttgacgcgaaaatctctgaactggtttaccagcaggttcaggaatctctggcgggtctgcacaacaacctgaacgaatacctgtgggcggttaaaaacaccgacccgaactacatcacccagaaattcaacatcgcgcacggtcacttcatccaggaactgccgcacttccagtctaaaggttacgaactgctgctgctgccgctgttcgcgcagttcgcgaacctgcacctgtctctgctgcgtgacggtgttatctacggtgcgtcttggggttggggtgaagaagttcagcagcacctgcgtgaacagatcgttgaaaccatccagcagtacgttcagtacaccgacaaaacctacaccgaaggtctgcagaacacccagtctaaagcgccgtctaacaaacactacaccgaaccgttcaacaccgttaaccgttacatccgtgaaatgaccctgaccgttctggacttcaaaaccatgtggccgtactacgacccgacccagtacccgaacccggttaaaatctacctggaccgtgaaatctactctgacgcggttggtaccgcggacaactctggtccgatcaccctgccgtctccgccgaccaaagcgatcaccaaaatcgaagtttgggcgtgggaccgtatcgacggttgccaggttacctacgaacagggtggtggtccgaacggtgttacccagaccccgcgtatgggtgaccagggtggtggttcttcttctccgccgcacggtggtgttttcgacctggttacccgtggtccggttgttggtgttaaaaccctgtctggttctatcctgaacgcgtggtggttcaccttcgacgacggttctacctctaaccagctgggtccgggtggttctgaccactctttctcttacccggacgaaatcctgtcttctatcaaaatcatgtctgcggactgcgcggttttcggtttcaaattcaaacagtacgttgcgtctccggcgaaaatctctgttaaaaccggtaaactgatccaggaatgggaccgtatccagaccgttccgggtgttgactaa

SEQ ID NO: 300 - DNA, 879 bp, Microcoleus Sp.
atgactgtagctggcgatcgcttgacaaattttcctgactctgaatgcgtcggacagcctgacggaatcagttgggactggcagagttctgaaggcttgccctatctgacttgcagcttgctttctcgctggtctcacggcttttttactcgcgatttctcgccccgggggccgatcgatctgacggaagttctcgaacctggagctaaggtttaccgactccaacaggtacacggcaatgcggtactcaaaacgagtgagttgtccccggttgtggctctgggaccggaaactgctgccccaagctatgctgaggctgatggcttggttgccgagcgagaattggaggcgctgtgggtttgctcggctgactgtgtgccggtgctgattgctgacgatcgcacgggactcgttgcggcagttcacgcgggttggcgcgggactgctgctaagatattaccagagacgatcgctcaacttgtggcacaaggcagtcaactagaaaatctgaagattgctatggggccggcgatcgctggaaaggtttaccaggtatctgtggaagtagcagcggaactgggagccactatagctcctaagagtgccgttagtgcgacagccgacggcattctagagtttttgcaccaactgccggaaacgcctgtctttgccgatccagaaccgggaaaggtacgcttggatgttcgcctctgcaatgctttgcaattgcagcagttggggatcgatttttctcaagtggcgatcgctcctttctgtacttattctgactcggctcgctttttttcctaccgccgcgatcgacttaaaaaagtccagtggtcgggaattgtgagtgcctgcgggacaagttccttctga

SEQ ID NO: 301 - DNA, 879 bp, Oscillatoria Sp.
atgactgtagctggcgatcgcttgacaaattttccagactctgagtgcgccggaggggctgacggtatcagttgggactggcagagttctgaaggcttgccctatctgacttgcagcttgctttctcgctggtctcacggcttttttactcgcgatttctcgccccaggggccgatcgatctgacggaggttctcgaacctggagctaaggtttaccgactccaacaggtacacggcaatgcggtacttaaaaccactgagttgtccccggttgcggctccgggcccggaaaccgctgcctcaagctatgctgaggctgatggcttggtggcagagcgagaattggaggcgttgtgggtttgctcggctgactgcgtgccggtgctgattgctgacgatcgcacgggactggttgcggcagttcacgcgggttggcgcgggactgctgctaagatattaccagaggcgatcgctcaacttgtggcacaaggcagtcaactagaaaatctgaagattgctatggggccggcgatcgctggagaggtttaccaggtatctgtggaagtggcagcggaactgggagccaccattgctcctttgagtgccgttagtgcaacagccgacggcatgctagagtttttgcaccaactccccgaaacgcctgtcttggccgatccagaaccgggaaaggtacgcttggatgttcgcctctgcaatgctctgcaattgcagcagttgggaatcgatctttctcaagtggcgatcgctcctttctgtacttattctgactcggctcgctttttttcgtaccgccgcgatcgacttaaaaaagtccagtggtcgggaattgtgagtgccagcaggacaagttccttctga

SEQ ID NO: 302 - DNA, 3720 bp, unknown
  environmental sample
atggccaaggttttttacccaggttccgatgagcttgaagtcgtcattacggatataggctttcatgccaatgatcatgccgtcgaaaccctcgacttcaagacgggcaatgaaacgctgatcgggccgcaacacaaacaacgactgcgccaactcgaagttgtcgatcagttgtatggcccgctgcacatcggttccgtgacggtgactcgccaggccctggatgcactgggtgcaacgaccaatgggcagcctctgaacggcgacaatacgtttttccgcacgccccaccgatttttcctcaatacgttgcagttcaacccggttgatatcgaaacacggataaagctgaccaccaacggcaacgactatcgcttgccaacccttctgttcgaaatcgccagtgagcgctcgtccatcgcccctccgttgttgaacagcccccctgaaacagcctccgagccagcccgttatcggagcgcccttgaaaaacttttaaacgccgcccaacaactcaataccgcctcgcttgcacaacgaacattcagttgggtgaacaaagccaagagcaacgtccttattccaacgggatttggacttcaggccttcggtatctacagtggcctgcgtggcttgcaagacgccatccgcaacaagaacgcctaccagaccgtcttcaacggagccagcgtgactgccgaactggcctcgatcggtgtcgaggctgcggtgagcaggcaagccatgcaaatgctcaaggcgggccaaagctctctaggaagtttcgccaagacaacctttgccttacggctggggcgtggcagcggcttgattgccagcgtgctgacactgcccttcgatatcgtcgcggccgtcgacgctttcaaggcggccgccaagactaccggcaaagacgccaccgatcattacgtcagtgcagccttgagcgttaccagcgccaccatgtccgtgatgatcggtgcggcggcgctggccgggttcagctcagccggccccgtgggccttgccgcgggcctcatcctggcggtgggttcgcaaatctggggggcgattcgtgaagtcgatgaaatcgatgactacatcacgctcaccgtgcatgagcgcctgcgcaccggttggttcgccttctggacgatcagccccgatgacgatatccaggcgcgctataccgtcgccaaggcgaccgctgaacatacgaagcaacttcgggccaacgccttggcattactgcaaggcacgttgaaagacagcaccgaagccatcgtcaatggaaagttcggcgtcgaactcgaacaggtgacttacaacacttggaattggtggaccggtgaacgctaccaagcgacccgagtgcgccccaggatcaccgacagcgacgatttcatcgatgcccacgacggggtcacggccgatacccccggggccgttcttggcacctcggcggaacacaaaggtatccattggtatatcggcggtggcaacgacaccatcgtgggcgtcgagaaaaagccgaacgtcttccattacggagcaggcatcaaaaaactcaccggcggcgaaaaggacgatgttttcattttcgagggttcgaggcaggccatcaccagaagcacgataaatcgctcacccaactggctattcgggggcacggggaacgataccgtcattttgtccggcaacatcagaagcgagcaggaacaacgactcggttatcacgtcgatctggaagccgggcatttatctgtcatcacgccggcgagtcaaaaggctccgaccgggcactatcgccatgcggttatggaaagtgtggagaatgtggagatcttggagggcggcgccaacgtcatcaagggcacgactggcccgaacatcatcaagtctcgtggcaatgattcaatcgaggccggtgccggagatgaccagattttccttttgggtggaaatagccgcgacgcggacggtggccctggagaggatgtctatgccatcgcccataaacctggccgtgtctccatcaccgaagacggccggggcaacagcgtcatcgcgctggattggagggccgacctgattgacagctggcgcgttaaggaaggccaactgatcgtgacttcctgctttgattcggacgactggcaacgtcgcgaagttgtcatcaacaacgtttaccaaacttcggatccgggacttttacaaaacaacaaactgacgttcatgacaaaggacggctaccacttggtacccgacctgccggatatgatcggacagggccactcgctcgacatcgaggccgtcgtggtacaactgggaacaccgcgaaacccgagcatcttgcacgatcagaaagagcatcaggttcctcatgacaaagattcgagctacttcctgtcacggcggatcgagttcagcacactcgatatcaagcagaaaagcgacttctgcaccaccttgcacctggattatgcccactccgagctgacgcgggtcgaggcccactacaacgcctatgtcagccaagagggggaagcaagcaccgcaaggtatggagaatgcagcctgacgctctacttcggtgttcgccgggtgctgttaaagaacctggccagttcggatgagcgctatagcgcgcgggaccctcgtaccgggcgacgtgccttttccgtcgtgggtctgcatcacatcatcatactggtcatgaatgacggatcgtcgtatcgcctcaccgtgccctcgcccgacgaaggccaaatgctggatgaaaagttcatcagtaaagacccggtgaaatggaaaaccgtagcgccccagtccatcagtctcaccaaaaagaaatatgcctttctactccctctggacaaaaaaccctacgccatgggccgccgggcgacctgtgccctgctgacatcgccttctgaacagacgggcgtagaagtcctcatcggcgaaggcgctacctatctggtccacctgagccaggacatgacgctacgtctgtcgacaccgggcgcactggccagcgcgaacccgcagttgccccatgcctccgtctgggagctcgacgccacgcacctgggccaagtcgaaatcaaactcgacgccaacctgctgcaggttggaagaacggttatccatcttcccgtgtatgaagctcaagaccttatcgacccgatacgtgtcatcactgcccaaggcattgtttacgcagtcgacgtgctatttgagcgggtttatgtcgaagcgctggatggccgttactttacgccccctgtcgaccccaccgccccatggcccagcgaactgtccggcctaacatccaagaaactcaaggttatgaacgttgccctcaaggatgggtctgcgggcgccttgagttatcacctgggaacacgccaatggaccctggagaccgacaaagcccggcccatcgttgcccaggacctgaaaaaaaccaacctttgcgaccaccatctcagcctctaccgggacctggcgcgcgaaggcctcagccaaatcccgcccaccgacgacggcgcacttcgcttgctgcgggaaaagtgcgtggcactggcggaaagcctcacgccgggcaactcgaagtccttggtgcaaaccctgacgcttagcctggccttcggaatgagcgcgcctcaattaagcgggcttctttcattgcaagggctcttacccgcctatttataa

SEQ ID NO: 303 - DNA, 5127 bp, Enterococcus Sp.
atgaaaaagacaaaaattctgaatagcctgatgattatcggcttggtgttaggaagtatgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaacaaccaattgagaaaaataaaaggactagtgccaggaataataatccaagcgataattttgatagtgttcaaggaaacaacggtaattactttaaaccgactactgatgcaactttactgaaaattggtgaagagcaggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagatactagtaacaatttattgatggcagaagagagcgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggattttttttttggaaacgaaaaatgtctaagaaatcgtttgataaacagtaa

SEQ ID NO: 304 - DNA, 5127 bp, unknown
  environmental sample
atgaaaaagacaaaaattctgaatagcctgatgattatcggcttggtgttaggaagtatgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaaaaatcaattgagaaaaataaaaggactagtgctaggaataataatccgagcgataattttgatagtgttcaaggaaacaacggtaattactttaaaccgactactgatgcaacattactgaaaattggtgaagagcaggcagctcgagtgcaatcagatttgtcaaaaacaacttttaatatttctgacttgcaacacgagaaagacgacagctttgaagttttaaatttttctaagagtgcttttccgaatgataaaggattggttatgtggccattaggtggagggcgtaatgatgtctattggacgcaagtagattctaacagtggaatttggcggatgcgcctatacgcttcaatggcttcaacaagcgagccttatttaaatgcaagatttactcgactaaaatacggttctgtcagtgggaatgaagtatttgtctttccaagagtggcttatttatcgaatcctacatctaatgttaacgatatgaaaccatttctcatggcagctacatttgaagtacggttaccgactgctgaagaggaaatcggtaaaattgtagcaactgccaaagaaggtacacataaactcatgcaaaatactcaaccgatccctaatccagaaacttatctagatgtaaaaaatacacgtggaaaagttgaatatagttggaaaatagcccctgatacaacgaaagtaggaaagcaagatacgaagattttagtaaaagacgagtcgggtagagaaatagaagcagtagttccaatcactgtagaacctctagctgtagagatcgagggaaaaccaggaccatttgacatttatcaatatgataaattgccagatgtgactgaatactttgaagtaacaaatctgtatggtacctatacgctaaaatggtttgatgatgtgaatactgattcgccaggcgaacaaacatggcgagcaaaagtaacaacttctgatggacgtgaagcaactgcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgtggaggcagattatcggataggtggtcttcaaacgctcaaattgacagttcaaaccaagcatccaaatagcggtgtgatgattaaaggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagttccccattttcgctatattattcgtttgaagttttacgaggcgaaacagtcgtttatagccaagaagtgacaaatcgcgcaacttggcagcaaatcatggataaatttggagattctactggaacgatcgatgtccgttatggtgatgtcattaagatatatcatccagaacgaacgccgaatagttcagtcttgatgattgacgaacaggaacaggattatacatatgatacggcgtacgcctactacaagattactccttatggatttgatccattccccttgctagaagcagaagcttcacaaaagagttttgttttaggcgagaacactaagacaattgatccagcttcattaataaagaatgtaacgatcaatggtcgagtagttgatagtagtttatacgaagtggaatcattgatcgattttgatacaagtagtattggaacaagaaaaatgaaattgaaagtcacgatgaatgatggactttcagcagaggaattcgaagtcgattaccaggtcaaatggggcagcacatttgtgctaaaaggcttgggggatgagacggttggcgcatttagtctgctaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtgctaggaaatcaatcgattagagatgggatcgaagggttcaatcaaggaaaaccattaaccgtcaaacaaggtgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtctaggtgatgatgccacagagattgatggaacccaactgattaattatgtgacgatcaacggtaccgagttaacaccggatttatatacagtgaagcaattaggaaacttcgatacaaccacagttggtcaaaaagaacttgctatccaatttgacacaaaagatggggtagtatcaaaagtcatcacagtgccttatgaagtgaaatggggcagaacgatcgtgatgaaatctagcaccggtggttcagcaggtgttttctcactgcaaactactaatacgacaagacaattgaaaatccatcatgggtttgactcgccattagacgagcgcttaggaaacgatcaagacctctattattcaattgaagtcctacggggtgaaagagtccattatagtcaagaagtcccaggtcgtgtcacgttacaagacgtcatcaacagctttggaactaatggtactcaagctgtcactgtccagttagatgatgtgatcaaaatttatcacccgcaaaaatctcctggtagctcggtactgatggtcgatgaactagaagaggacttcacgtatggttcagattatgcgtattacaaagtaacgacttatggttttgaagcaatgccagtcatggaagtccatacagctaataaagccttttatctcgcgcaagatgtgactactgcagctgatgctgaattaattgatcgtgtgacgatcaacggcaaaacagtcgatccagaggaatacacgatcgaaagacgttcagaaatcgatacgacaacgataggaaataaaaacgtctctatgcgtgtgaaaatgaacgatggtttatctagtgtgcaacttgaactgccttatcaagtcaaatggggaagtacatttgttctgaaaggcgaagagaaagaagggaaaagaggcatcgtcggttcttttagcctgcttgatcaaaatgatgagttggctatctatgccacgaaaggcgaagatgaaacagaacttaatgcgccagtcaatcctgcctatggtcggaatgcctattatcgaatcgacatcctagcagatcctaaaaataaagcaaatagtttatttcccgataacatcaaatatacttatgaagtggcaggtaatcaaacggttcgtcaagcaatcgaagggttcaataatggccaatcattacctgtggaagaaggagacattttccgtgtctaccatgcagaaacagataaccagaacttactgatgtgggatgatatcgtcaaaaactatacagctgggttgaattacgcttattatgaagtcaagaatggcgagtttgagccgattacgatgatttacgcagatgttgctagtcaggaactcgtcttaggtgaggataccagtgaggtagacgtgacaacgttgattgagaatgttgcattcaacggacagagtttgaacacagagctttataaagtagaacaaatgggagcgtttgatacccatacgacaggagaaaaaacagtaacggtaaaagtatcgacagcagatggtgtttcttcgactgacatcgaagtgccttatgaagtgaaatggggtagcacgatccatttgaaaaatcgtaaaggtgaaacggttggatcgtttggtttacttaaaaacagcaaacaaattgaaatccaatctgtccaaggaaccgatcaaacagtattgaagaatcgagtgaatgaatacgatgacaccgaagtatattatggaatcgaaattctcaacgaacgtaagcaaagcaaatatcaatacgaggttcgtggcacacaaacgatcgagcaagccatttcacgttttaatactggtaaatcactggcggtgtccccaggtgatatcgtgaaggtttatcacgtagatactagtaacaatttattgatggcagaagagaacgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttccctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggatttgttttttggaaacgaaaaatgtctaagaaatcgtttgataaacagtaa

SEQ ID NO: 305 - DNA, 5070 bp, Enterococcus Sp.
atgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaaaaaccaattgagaaaaataaaaggactagtgctaggaataataatccgagcgataattttgatagtgttcaaggaaacaacggtaattactttaaaccgactactgatgcaactttactgaaaattggtgaagagcaggcagctcgagtgcaatcagatttgtcaaaaacaacttttaatatttctgacttgcaacacgagaaagacgacagctttgaagttttaaatttttctaagagtacttttccgaatgataaaggattggttatgtggccattaggtggagggcgtaatgatgtctattggacgcaagtagattctaacagtggaatttggcggatgcgcctatacgcttcaatggcttcaacaagcgagccttatttaaatgcaagatttactcgactaaaatacggttctgtcagtgggaatgaagtattcgcctttccaagagtggcttatttatcgaatcctacaggtaatattaacgatatgaaaccatttctcacgaaagctacatttgaagtacggttaccgactgctgaagaggaaatcggtaaaattgtagcaactgccaaagaaggtacacataaactcatgcaaaatactcaaccgatccctaatccagaaacttatctagatgtaaaaaatacacgtggaaaagttgaatatagttggaaaatagcccctgatacaacgaaagtaggaaagcaagatacgaagattttagtaaaagacgagtcgggtagagaaatagaagcagtagttccaatcactgtagaacctctagctgtagaaatcgagggaaaaccaggaccatttgacatttatcaatatgataaattgccagatgtgactgaatactttgaagtaacaaatctttatggtacctatacgctaaaatggtttgatgatgtgaatactgattcgccaggcgaacaaacatggcgagcaaaagtaacaacttctgatggacgtgaagcaactgcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgtggaggcagattatcggataggtggtcttcaaacgctcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagttccccattttcgctatattattcgtttgaagttttacgaggcgaaacagtcgtttatagccaagaagtgacaaatcgcgcaacttggcagcaaatcatggataaatttggagattctactggaacgatcgatgtccgttatggtgatgtcattaagatatatcatccagaacgaacgccgaatagttcagtcttgatgattgacgaacaggaacaggattatacatatgatacggcgtacgcctactacaagattactccttatggatttgatccattccccttgctagaagcagaagcttcacaaaagagttttgttttaggcgagaacactaagacaattgatccagcttcattaataaagaatgtaacgatcaatggtcgagtagttgatagtagtttatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgggggatgagacggttggcgcatttagtctgctaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtgctaggaaatcaatcgattagagatgggatcgaagggttcaatcaaggaaaaccattaaccgtcaaacaaggtgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtctaggtgatgatgccacagagattgatggaacccaactgattaattatgtgacgatcaacggtaccgagttaacaccggatttatatacagtgaagcaattaggaaacttcgatacaaccacagttggtcaaaaagaacttgctatccaatttgacacaaaagatggggtagtatcaaaagtcatcacagtgccttatgaagtgaaatggggcagaacgatcgtgatgaaatctagcaccggtggttcagcaggtgttttctcactgcaaactactaatacgacaagacaattgaaaatccatcatgggtttgactcgccgttagacgagcgcttaggaaacgatcaagacctctattattcaattgaagtcctacggggcgaaagagtccattatagtcaagaagtcccaggtcgtgtcacgttacaagacgtcatcaacagctttggaactaatggtactcaagctgtcactgtccagttagatgatgtgatcaaaatttatcacccgcaaaaatctcctggtagctcggtactgatggtcgatgaactagaagaggacttcacttatggttcagattatgcgtattacaaagtaacgacttatggttttgaagcaatgccagtcatggaagtccatacagctaataaagccttttatctcgcgcaagatgtgactactgcagctgatgctgaattaattgatcgtgtgacgatcaacggcaaaacagtcgatccagaggaatacacgatcgaaagacgttcagaaatcgatacgacaacgataggaaataaaaacgtctctatgcgtgtgaaaatgaacgatggtttatctagtgtgcaacttgaactgccttatcaagtcaaatggggaagtacatttgttctgaaaggcgaagagaaagaagggaaaagaggcatcgtcggttcttttagcctgcttgatcaaaatgatgagttggctatctatgccacgaaaggcgaagatgaaacagaacttaatgcgccagtcaatcctgcctatggtcggaatgcctattatcgaatcgacatcctagcagatcctaaaaataaagcaaatagtttatttcccgataacatcaaatatacttatgaagtggcaggtaatcaaacggttcgtcaagcaatcgaagggttcaataatggccaatcattacctgtggaagaaggagacattttccgtgtctaccatgcagaaacagataaccagaacttactgatgtgggatgatatcgtcaaaaactatacagctgggttgaattacgcttattatgaagtcaagaatggcgagtttgagccgattacgatgatttacgcagatgttgctagtcaggaactcgtcttaggtgaggataccagtgaggtagacgtgacaacgttgattgagaatgttgcattcaacggacagagtttgaacacagagctttataaagtagaacaaatgggagcgtttgatacccatacgacaggagaaaaaacagtaacggtaaaagtatcgacagcagatggtgtttcttcgactgacatcgaagtgccttatgaagtgaaatggggtagcacgatccatttgaaaaatcgtaaaggtgaaacggttggatcgtttggtttacttaaaaacagcaaacaaattgaaatccaatctgtccaaggaaccgatcaaacagtattgaagaatcgagtgaatgaatacgatgacaccgaagtatattatggaatcgaaattctcaacgaacgtaagcaaagcaaatatcaatacgaggttcgtggcacacaaacgatcgagcaagccatttcacgttttaatactggtaaatcactggcggtgaccccaggtgatatcgtgaaggtttatcacgtagatactagtaacaatttattgatggcagaagagaacgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgtagatggaatttcagcagagactggattaggtgagggttccgcagctgaaggtgatgagagtaaattgccacaaaccaatcaaaccatcaatcgagtactgccatatattggtgcatgtttcttactaatagtaggatttgttttttggaaacgaaaaatgtctaagaaatcgtttgataaacagtaa

SEQ ID NO: 306 - DNA, 4464 bp, Enterococcus Sp.
agcatagagtcaaagactgagaagacatcattggttgaaaaaaaacaattttcaatagaaccaaacaaagaagaagacaaaataaacaacaaaaaaatagctatcaaagatgaaagtaatgaacaaccaattgagaaaaataaaaggactagtgccaggaataataatccaagcgataattttgatagtgttcaaggaaacaacggtaattactttaaaccgactactgatgcaactttactgaaaattggtgaagagcaggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagagtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgatgtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagataatagtaaaaatttattgatgacagaaaagagagaacgaaactaa

SEQ ID NO: 307 - DNA, 4248 bp, Enterococcus Sp.
atgaaaaagacaaaaattctgaatagcctgatgattatcggcttggtgttaggaagtatgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaacaaccaattgagaaaaataaaaggactagtgccaggaataataatccaagcgataattttgatagtgttcaaggaaacaacggtaattactttaaaccgactactgatgcaactttactgaaaattggtgaagagcaggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgactactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgaaggtggagtttcttcgactgacattgaagtgacatatgcagtgaattggggcagcacgaccaatttaaacaattgtagaggtaaaagggttcgatctagt

SEQ ID NO: 308 - DNA, 4155 bp, Enterococcus Sp.
atgaaaaagacaaaaattctgaatagcctgatgattatcggcttggtgttaggaagtatgaatgatgctgttgtacaagcaatttcgagcatagagtcaaagactgagaagacatcattggttgaaaaaaaacaattttcaatagaaccaaacaaagaagaagacaaaataaacaacaaaaaaatagctatcaaagatgaaagtaatgaacaaccaattgagaaaaataaaaggactagtgccaggaataataatccaagcgataattttgatagtgttcaaggaaacaacggtaattactttaaaccgactactgatgcaactttactgaaaattggtgaagagcaggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaacaaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatggtcgacgaacaggaacaggattatacagatgatacgacgtacgcctactacaagattactactgatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatgga

SEQ ID NO: 309 - DNA, 4107 bp, Enterococcus Sp.
agaaaatttgaaattaataaatatcataaattgccagatgtgactgaatactttgaagtaacaaatatgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagatactagtaacaatttattgatggcagaagagagcgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggattttttttttggaaacgaaaaatgtctaagaaatcgtttgataaacagtaa

SEQ ID NO: 310 - DNA, 4020 bp, Enterococcus Sp.
aaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagacccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagatactagtaacaatttattgatggcagaagagagcgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggattttttttttggaaacgaaaaatgtctaagaaatcgtttgataaacagtaa

SEQ ID NO: 311 - DNA, 3789 bp, Enterococcus Sp.
gtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaact

SEQ ID NO: 312 - DNA, 3726 bp, Enterococcus Sp.
caggcagctcgagtgcaatcagatttgtcaaaaaaatctataaatatttctaacttgcaacatgagaaagacgacagctttgaagttttaaacttttctacgtgtatttttccgaatgataaaggattggttatgtggccaataaatggagggcgtaatagtgtctattggacgcaagttgattccaacagtggaatttggcggatgcgcctgtacgctgcaatggattcaaaaaacgaaccctatttaaatgcgaaatttactcggctaaaatacggttctgtcagtgggaatgaagtattcgcctttccaagagtggcttatttatcgaatcctacaggtcatataaacgatatgaaaccatttctcacgaaagctacatttgaagtacggttaccgactgctgaagaggaaatcggtaaaattgtagcaactgccaaagaaggtacacataaactcatgcaaaatgctcaaccgatccctaatccagaaacttatctagatgtgaaaaatacacgtggaaaagttgagtatagttggaaaatagcccctgatacaacgaaagtaggaaagcaagatacgaagattttagtaaaagacgagtcgggtagagaaatagaagtagtagttccaatcactgtagaacctctagctgtagaaatcaagggaaaaccaggaccatttgacatttatcaatatgataaattgccagatgtgactgaatactttgaagtaacaaatctgtatggtacctatacgctaaaatggttcgatgatgtgaatactgattcaccaggcgaacaaacatggcgagcaaaagtaacaacttctgatggacgtgaggcaacttcttcgattcagatggatgtgacgccacatgagggcttaaaggttaacctcaaatcaattgaagatcgaaaactcggttataattatccaacatttgcaacaaactttagagattatattgattcggtcactatgcatggtgaaccagtcgaattaagagatcttgaatttattccacaagaaagtgcggaggcagattatcggatagggggtcttcaaacactcaaattgacagttcaaaccaagcacccaaatagcggtgtgatgattaagggaactggtgaggtaacactcaatgttctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaacta

SEQ ID NO: 313 - DNA, 3633 bp, Enterococcus Sp.
ctttgggaccactcgattttgatgaaatcaatcaatggtgaatcagctggatcatttactttaagaacagataattcaggaaatgagacggcaaaagttgtatttgggatggggataccaacctcaataaatacggcagttggtccgcagagtactccattttcgctatattattcgtttgaagttttacgaggcgaaacagtcatttatagccaagaagtgacaaatcgcgcaacttggcagcaaatcatggataaatttggagattctactggaacgatcgatgtccattatggtgatgtcattaagatatatcatccagaacgaacgccgaatagttcagtcttgatgatcgacgaacaggaacaggattatacatatgatacgacgtacgcctactacaagattactccttatggatttgatccattccccttgctagaagcagaagcttcacaaaagagttttgttttaggcgagaacactaaaacgattgatccagcttcattaataaagaatgtaacgattaatggtcgattagttgatagtagttcatacgaagtggaatcattgatcgattttgatacaagtagtattggaacaagaaaaatgaaattgaaagtcacgatgaatgatggactttcagcagaggaattcgaagtcgattaccaagtcaaatggggcagcacatttgtgctaaaaggcttgaatgatgcgacggttggcgcatttagtctactaaaagaaaacgatcaatgggcattgcatgctagtcaaggagtaaatgggacagacttgagtcaaccggtcaataatcattttggccgagacatctactatggtattgaagtgatcgaaaatattactaccaaataccaatataacgtactaggcaatcaatcgattaaagaaggaatcgaagggttcaatcaaggaaaaccattaaccgtcaaacaaggcgacgtcatcaaagtgtatcatgcagaaccaacaggtaatagtctattgatgcaagatgaaatagccaaagactttacaatgggctcaaatgatgcctattacgaagtcacagagcatgggctagaaccgatcctcgcgatttctacggatactaaaccacaagaatttagtttaggtgatgatgcctcggggattgatggaacgcaactgatcaatcaggtaacgatcaatgggaccgagttaacaccggatctatatacagtcaaacaattaggaaacttcgatacaactacagtcggtcaaaaagaacttgctatccaatttgacacaaaagatggggtagtatcaaaggttatcacagtgccttataaagtgaaatggggtagaacgatcgtgatgaaatctagcactggtggttcagcaggtgttttctcactgcaaactactaatacgaccagacagttgaaaatccatcaagggtttgactcgccattagacgagcgcttaggaaacgatcaagacctctattattcaattgaagtcttacgtggtgaaaaagtccaatatagtcaagaagtcccaggtcgtgtcacgctacaagaagtcatcaatagttttggaactaatggcactccagctgtcactgtccagttagatgatgtgatcaaaatttatcacccccaaaaatctcctggtagctcggtactgatggtcgatgaactagaagaggacttcacgtatggttcagattatgcgtattacaaagtaacgacatatggttttgaagcaatgccagtcatggaagtccatacagctaataaagccttttatctcgcacaagatgtaactactgtagctgatgctgaattaattgatcgtgtgacgatcaacggcaaaacagttgatccagaggaatacacaattgagagacgttcagaaatcgatacgaaaacgattgggaataaaaacgtcgctatgcgtgtgaaaatgaacgatggtttatctagtgtacaacttgaactgccttatcaagtcaaatggggaagtacatttattctaaaaggtgaagaaaaagaagggaaaagagggatcgtcggttcttttagtctgcttgatcaaaatgaccagttggctatctatgccacaaaaggcgaagatgaaacagaacttaatgcgccagtcaatcctgcttatggtcgtaatgcctattatcgaatcgatatcctagcagatcctaaaaataaagccaatagtttatttcccgataacatcaaatatacttatgaagtggcaggtaatcaaacggttcgtcaagcaatcgaagggttcaataatgggcaatcattacctgtggaagaaggagacattttccgtgtctaccatgcagaaacagataaccagaacttactgatgtgggatgacatcgtcaaaaactatacagctgggttaaattacgcttattatgaagtcaataatggcgagtttgagccgattacgttgatttacgcagatgttgctagtcaggaactcgtattaggtgaggataccagtgaggtagacgtgacaacgttgattgacaatgttgcattcaacggacagagtttgaactcagaactatataaagtagaacaaacgggagcgtttgatacccatacgacaggagaaaaaacagtaacggtaaaagtatcaactgcagatggagtttcttcgactgacattgaagtgccatatgaagtgaaatggggcagcacgatccatttaaaaaatcgtaaaggtgaaacggttggatcgtttggactacttaaaaacagcaaacaaatcgaaatccaatctgtccaaggaaccgatcaaacagtgttgaagaatagagtgaatgaatacgatgacaccgaagtatattatggaatcgaaattctcaacgaacgtaagcaaagcaaatatcaatacgaggttcgtggcacacaaacaatcgagcaagccatttcacgttttaatactggtaaatcactagcggtgaccccaggtgatatcgtgaaggtttatcacgtagatactagtaacaatttattgatggcagaagagagcgaacgaaactacacctatggcagtaattacgcgtattataaggtaacagattatggttttgagcctacaggtgagttaacagttgaacctgctcagccttcttttgcacaaggcactgaaagagttgacctgaaatcgttagtaaaagaagtgaaagtcaatgggcgtgtaatacctaaaaacgtctatactgtttctttagatggaacatctgaaatcgatacagaaactatgggcagtcgttttgtttctctcgatgtcaaagtggatcggagttatgggagtttatctactcgtacagaatcttcatatgaaatcgttgaacctggacaagaaacagcgccaggagaagaggacgctagtgcagaagatggtactggtacatccaacgatccagatgcagatggaatttcagcagagactggattaggtgagggttccgcagccgaaggtgatgagagtaaattgccacaaaccaatcaaaccatcaatcgagtactgccatatattggtgcatgtttcttactaatagtaggattttttttttggaaacgaaaaatgtctaagaaatcgtttgataaacagtaa

SEQ ID NO: 314 - DNA, 2508 bp, Pantoea Sp.
atgccaacggtacctacttcacagcgacagattttagatcagggactgcccgcaccgcaggttagcgttcagaccaaccccgatacattcggcgcaggctggggtgaggtaggcaatcgcattgctggcatctttgctcaggagcagcataaagcgaacgttgctcagacgcaggacgctgtgcttcagttccagtcatttgccgatgatcagttcaataacactgattctggcctgtatacgaaacagggtaaaaacgctgtcggtcagtctgaggcggtgcttagtaacattcgtggtaaggcagaggagctttcgaagcaggttcctgaagcaatgcgccgtgatttcatccagcagataaatcaggcaggccagcagtataagcgacaggccagcacgtatgaaatcgggcaggttcggcagtatgaggaaggccagtttaaagcccttcaggaatccactgtcactgcagcacagggacaatacaatgatccgcaggctttcacctcaacagtaaaacagggctttactgctattgaccagtttgccgatgcccatgggtggagtgatgaagagcgatccaatgccaaaaaccagctgaaagagcgttctgctgatggcgcattgtcggcggcagccaaccagaactatatggatttcatcgctgctaatggtgagccgggcgattatgatggcgcggtgcgcgtaagcggaagcacaggtgatgcgcgcgggcttcgcaacaacaatcctggcaacatcgaagcaggccagaataactgggaaggtcaggcgggcagcgatggtcggtttgctaaattcgtgacgccggagcacgggatccgcgcgctgggaaaaaaccttttgtcatatggcgataaggggttcgatacggttaatgaaatcgttaaccgctgggcgccagcatcggacggtaacaacaccaccgcctatgttaaagctctgtgcgagcagctcagtgtaaagcctgatgaccagctcaacctcagcgatcttaacgtgttaaaaaaacttagcgccgggattgtgaagcatgagaatggcagcattccatacagcgacagccagcttgataccggtcttcgtgcagcgctgggactgacggctctggatagcccgaagcgctacaccggcaacgtagcttttgacgcagccagtccacaggctcaggcgtcatacctccggcaggctaagtcacttcagggagaggcacgtactcagcttaaagcgcaactaactgatgtgatcagcgatgccaaagcgtcatatctcaaaggcgtcgagtacccgaatccgccaagtcaggcacagctgatttcagcttatggctatcgcgaaggaaaccagcgctttgccgatctggaaaaccagcgtgtcgccggtcagtacattggttcattccgtaatatgccgagcagcagcatcactaactacgtagctgatctgaaaacgcaactgggcagtggtgaagggtttgccggtcgcgccgatgcttatgatcacgtcgaggcagcagcgaagcaggtgattagcctgcgggaatcaaatccctaccaggcagcgatggacatgggagcatacaagccgatcgccagcaccaatccggctgacataaccagcgagattaagagccgcaccgccgcgacagatcagcttaaatcgctgggcatcaatgcgccaatcctgtcaaaagaggaagcagcatcaatcagcgaacgcgtgcgcggcacgacagatgtgaaccagtctatcagcctcctgcagtcatttggccgtgatctgcagccgcaggcattgcgaagtgtcgccgcgtcgattgcccctgatagcgccgcaacggcttattctgcgcttatcctgggcacagatgacaaccagtacaacaaccgctctccgtcaatcccatacagccagttcgtgtcttacaagccaaccatgaacaaatacgaggttgccaaaacaatcctgcagggtgatcagctgatcaatccgacgaaagcgcaaaaggatgccggtatcagcgcggtgaaacttcccgcggatgacaagctgaagcagacctttgatgacgaaatcggtaatgccttttctcacaatccgcaggcgcgtcagatggcctggtcaatctataagtcggcctatgccgggctggcctacaccagcggcgacagtgatggcgtgaataccaaagccgttgacagcgacattgcagagaaagcaatccagatggcaacggggggcgtgatcaagggcttcaacggcggtgacgttgtcatgccgtttggcatggataaatccaccttcaaagatcggtataccgccgccgccggcgaagcgctcaaatctgccgggcttaacccggcagcacaatcaaacttcattcccgtcaatgttggcgacagccagtatcggctggtgacaggcagcggccgctgggcgacagatccgaaaactggcgcgccaatcacagtgagggttcagtaa

SEQ ID NO: 315 - DNA, 2511 bp, Meta Sp.
atgccaacggtacctacgtataactccagacagactagcgaccagggattgccagcgccacaggtaagcgtacagaccagccctgataatttcggggccgggctggcagaaaccggtaacaggattgccggtatttttgctgaagaacaacataaggcgaatgtcgcacagagccagaatgctttgcttcagttccagtctttcgctgaggatcagttcaataacactgacaacggtctgtacacgaagcagggcaaaaacgctgtcggccagtcagaactggtcctgtctaatatccgtggtaaagctgaagaactcgcgcagcaggttccggagtcaatgcggcagcagtttattcaacagatcgatcaggccggtatgcagtacaagcgccaggctaacatgtatgagattggccaggttaaagagtacgaggaaggccagtttaaagcgttgcagcaggccacagtgacaactgcccaggcacagtacaacgacccgcaggcattcactgcgaccgtgaagcagggctttacagcgatagaccagttcgctgatgctcatggctggagtgatgaagagcgtgccagcgccaaaaataaactgaaagagcagtctgctgatggtgcgctctccgccgcgtctacgcagaactatatggaattcatcagccggaacggtgagccgggggattatgccggcgcggtccgcgtttctggttcaaccggtgattcgcgcgggctgcgtaataataaccctggcaacattgaagcaggtaaaaacacctgggacggacagaccggaagtgacgggcgctttgcaaaattcgttacccctgaacacggtatccgcgcgctgggtaaaaacctcatgtcgtatggcagtcagggttacgatactgtcaacgagatcgtaaaccgatgggctccggccagcgacggcaacaacacagcggcctatgtgaaagctctgtgcagccagttgggggtaaaggctgatgaccagctaaacctgacagatataaacgtactcaagagtctggcaactggtatcgtcaaacatgaaaacggtagcgtgccatacagccctgatcagcttgataccgggatccgtgccgctcttggccttaccgctctggatacaccaaagcgttacaccggcaacgccgcttttgatgctgcttcgccagaggcgcaggccgcctatcttcgccaggcaaaatcaatgcagggtcaggcgcagacacagcttaaggcgcagcttaccgatcagctttccgatgcgaaagccgcctacatgaaaggggtagagttcagtaatccaccatcacaggagcagctgattgccgcctggggttaccgggagggcacacagcgattcaacgatctacaaaatgaccgtgttgccggtcagtatatcggctctttccgtaccatgccgacagccagcattcagcagtatgttgccgggcttaaaaccgaactaggcaacggcgaagggtttgccagccgttcaggcgcttatgaccacgtggccgccgcggctaagcaggtcatttcaatgcgcgaatcaaatccctatcaggctgctatggacatcggagcatacaaaccgatcaccggaagcagcccggcggacattaccgcagaagttaaaaaccgcgcagcggcatcgggccagttgcagcagatcggcattaatgccccaatcctttcacgggaagaggcggcaaacgtcagtaatcaggtacggggcaccacggatgtcaaccagtcaatctcgctgttacagagctttggccgtaacctccagcctgatgcactgcgtaaagtcgcttcagctatagcgcctgacagcgcagcaacagcttattcagcgctgatccttggcacgcctgataatcagtatgacaaccgatctcctgtcatcccgtacagccagtttgtgccttacaagccaacgatgaataagtatgacgtggctaaaaccatcctccagggcgaccagttgatcaacccgaccaaagcacagaaagaggctggcatcagcccggtcaagttgccgtcggatgacaagctgaaacagacctttgatgatgctgtcggatcatcgttctcgcataatccgcaggcgcgccagatggcatggtctatctataaatctgcctatgccggactggcctacaccaatggtgacaatgacggcgtgaacaccaaaaacgttgacagtgacattgctgaaaaggccgtgcagatggcaaccggcggggttatcaaaggcttcaacggtggtgatgtagtgatgcccttcggcatggataaatcgacgtttaaggataaatacactgctgcagctggcgaagcattaaagtccgccggactcaatccagccgggcagaacaattttattccggttaatgtcggtgacagtcagtaccggctggtgaccggcagtggtcgctgggccacagacccacgcaccggcgcgcctgtgatagtgaggatccagtaa

SEQ ID NO: 316 - DNA, 1584 bp, unknown
  environmental sample
atgaataagaaaacccttatctcgtcactactaatcacccttgcttttctatttttaaatgtacaaaaggtcagcgcagctatcgattataatctttttaattacaattatccggtaagtgcctattatcctaaatcctcagataaagccaatgttatgggcagaataatcaaaataaataatgttagaaatgattattcagtttccattccaatggatatttctcaaaattcagaaggaaagctcaactattttgggttgacaacttctacaaatgcctattttacacatgattctggaaactcaatcactaatgcaggttctctcactggtccaaatactctggtaggccctggacttcaaaatcctgtcaaattaccaattcccagtagcacgataactattgatgggcaaacttactattttaactactatgttgttcaggtggtcacagaaaaagtgattagtccaatcaatgaggttcaaggaaataattatgctctgcaacctttagacactttaccagcaaatgccaacttcgcttgggcatattattctgatagccctggtgctatcattcattataaaacggaagatggtacagaattattaacttcgccaactcttattggtgaatcaggggatactattccctcagaagtaagagatttcacgggatatactttaatatctgttcccgaagaagatagttttaaaaaagcacaattaactaacttgacctatgtttataggaaaaatccagtagctactgctactgtaaccgttaaatatattgatacgcaaggaaattctatttcagattctatcccactttcaggtaatgtcgaccaagaatacactactgaacaaaaaattatttcgggctacacttttaaagaagttcaaggaaataaaagtggactattttcaactactcctcaaactgttacctatatctatactaaaaatccaatcgaaataaaaactggatcagtaactattaagtatgttgatacaaacggaaattccatttctgatgtaattacaaaatctggaaatgtagggtcttcttttgatagtgaacaaaaaattattttgggctacacttttaaagaagttcaaggaaataaaagtggactattttcaactactcctcaaaccgttacctatatctatactaaaaatccaatcgaaataaaaactggaacagtgactattaagtatgttgatacaaatggaaattccatttctgacgaaattacaaaatctggaaatgtagggtctttatacactagcgaacaaaagaaaattttaggatataatttcaaggaaattcaaggaattgcggagggacaatttacaattgaatcccaaactgtaacctacgtttatacaaagatttcaactcctacaataatcaaaacttctgtaattccacctaaaactttatcagtaaaaaccctaccaaaagaatctttacccgaaactggcgataaattttttggcttcactttactttcaggaagtcttctaattcttgttagcactaccctttatctattgaaatctagaaaatataaataa

SEQ ID NO: 317 - DNA, 1572 bp, Lactococcus Sp.
atgaataagaaatcccttatctcgtcactactactcgcccttgcttttctattttttaatgtacaaaaggttagtgcagctattgactataatctatttaattatgaatatccagtaagcgcctactatcctaaaagttctgataaagccaatgtcatgggaagaataattaaaataaacaatgtgagaaatgattattctatttccattccaatggatttcaatcagaactcagaaggaaagctcaactattttgggctgaccacttctacaaatgcttattttactcatgactcagggaattcaatcactaatgcaggttcaattactggtcctgacactttggttgggcctggacttcaaaatcctgtcaaattacctattcctaacaaaaccttgactgttgatggacaaacttacttttttaattattatgtggttcaagtggtcactgcaaaagtggtcagtccaatcaatgagattcctggaaataattatgcactgcaacctttagatactttaccagctaacgctaattttgcttgggcttattattctgatagccctggtgctgtcatccattataaaacggaagatggtacagaattattaacctctccaactattattggtgaatctggagattctattccctcagaagcaagagacttcacaggctatactttagtatcaattccagaagcagatacttttaaaaaagctcaattaacaaacttaaattatatttataagaaaagtccagtagctggggctacagtaacagttaaatatgttgatactaatgggttccctatttcagatcctatctcactttcaggtaatatcgatcaagaatatacaaccgaacaaaaaaatattgccggatatacttttaaagaggttcaaggaaataaaaatggacaatttacaacagagcctcaggctgttacttatgtctacacaaaaaatcctatagcaactggaaccgtaactatcaagtatgtggacaccaacggaaaatcaatttctgatgaaataataaaatctggaaatgtggccagtccttttagcaccgaacaaaaaaatattgccggatatacttttaaagaagtccaaggaaatataaatggacaatttacgacagagcctcagactgttacttatgtctactcaaaaaatcctatagcaactggaactgtaactattaagtatgtggacaccaacggaaaatcaatttctgacgaaataataaaatctggaaatataggtaattcatatactagcgaacaaaagaaaatttcaggatacaatttcaaggaagttcaaggaatcacagaagggcaatttacaaatgacccccaaactgttatctatatttatacaaaaaatccaactcctcaagtaattaaaacttctaaaattccatctaaaactttagcagtaaagactctaccaaaagaagctttacctgaaactggcgatacattctctcctttcgctttacttacagggagtctcttaatccttactagtgctacactttatcttttaaagactaaaaagcatgagtaa

SEQ ID NO: 318 - DNA, 1485 bp, Lactococcus Sp.
atgaataagaaataccttatctcgtcactactactcgcccttgcttttctattttttaatgtacaaaaggttagtgcagctattgactataatctatttaattatgaatatccagtaagcgcctactatcctaaaagttctgataaagccaatgtcatgggaagaataattaaaataaacaatgtgagaaatgattattctatttccattccaatggatttcaatcagaactcagaaggaaagctcaactattttgggctgaccacttctacaaatgcttattttactcatgactcagggaattcaatcactaatgcaggttcaattactggtcctgacactttggctgggcctggacttcaaaatcctgtcaaattacctattcctaacaaaaccttgactattgatggacaaacttacttttttaattattatgtggttcaagtggtcactgcaaaagtggtcagtccaatcaatgagattcctggaaataattatgcactgcaacctttagatactttaccagctaatgctaattttgcttgggcttattattctgatagccctggtgctgtcatccattataaaacggaagatggtacagaattattaacctctccaactattattggtgaatctggagattctattccctcagaagcaagagacttcacaggctatactttagtatcaattccagaagcagatacttttaaaaaagctcaattaacaaacttaaattatatttataagaaaagtccagtagctggggctacagtaacagttaaatatgttgatactaatgggttccctatttcagattctatttcactttcaggtaatattgatcaagaatatacaactgaacaaaaaaatattgccggatatacttttaaagaagtccaaggaaatataaatggaaaatttacaacggagcctcagactgttacttatgtctattcaaaaaatcctatagcaactggaaccgtaactatcaagtatgtggacaccaacagaaaatcaatttctgatgaaataataaaatctggaaatgtggccagtcctttcagtaccgaacaaaaaaatattgccggatatacttttaaagaagtccaaggaaatacaaatggacaatttacgacagagcctcagactgttacttatgtctactcaaaaaatcctatagcaactggaaccgtaactattaagtatgtggacaccaacggaaaatcaatttctgacgaaataataaaatctggaaatataggtaattcatatactagcgaacaaaagaaaatttcaggatacaatttcaaggaagttcaaggaatcacagaagggcaatttacaaatgacccccaaactgttatctatatttatacaaaaaatccaactcctcaagtaattaaaacttctgaaattccatctaaaactttagcagtcaatactctaccaaaagaagctttatctcaacccctatcttga

SEQ ID NO: 319 - DNA, 1155 bp, Lactococcus Sp.
atgaataagaaaacccttatctcgtcactactaatcacccttacttttctatttttaaatgtacaaaaggtcagcgcagctatcaattataatctttttaattacacttatccggtaagtgcctattatcctaaatcctcagataaagccaatgttatgggcagaataatcaaaataaataatgttagaaatgattattcagtttccattcccatggatgtttctcaaaattcagaaggaaagctcaactattttggcttgacaacttctacaaatgtctattttacacatgattctggaaactcaatcactaatgcaggttctctcactggtccaaatactttggttggccccggacttcaaaatcctgtcaaattaccaattcccagtagcacgataactattgatgggcaaacttactattttaactactatgttgttcaggtggtcacagaaaaagtgattagtccaatcaatgaggttcaaggaaataattatgctctgcaacctttagacactttaccagcaaatgccaacttcgcttgggcatattattctgatagccctggtgctatcattcattataaaacggaagatggtacagaattattaacttcgccaactcttattggtgaatcaggggatactattccctcagaagtaagagatttcacgggatatactttagtatctgttcccgaagaagatagtttaaaaaaagcacaattaactaacttgacctatgtttataggaaaaatccagtagctgctgctactgtaaccgttaaatatattgatacgcaaggaaattctatttcagattctatcccactttcaggtaatgtcgaccaagaatacactactgaacaaaaaattatttcgggctacacttttaatgaagttcaaggaaataaaagtggactattttcaactactcctcaaaccgttacctatatctatactaaaaatccaatcgaaataaaaactggaacagtgactattaagtatgttgatacaaatggaaattccatttctgacgaaattacaaaatctggaaatgtagggtctttatacactagcgaacaaaagaaaattttaggatataatttcaaggaattgcagagggacaatttacaattgaatcccaaactgtaa

SEQ ID NO: 320 - DNA, 1389 bp, Providencia Sp.
atgaatataaaaacctttaaatttatcgataaggattcaaatggcattgtcgttaattttgataatggaaacaaaaaaacagtcacaattagcttatttttagataatgaaaatatagaaaccatatcaactaataatgaccattatcttttcaaggtaggtaaatcgggaaactaccatgtaactatctcatttgctgatagtaataaaaatattttacacttaattgatagccctgttagctatcgtcttccccatcagaaaatcaataaaaaaataaaagcagaagtaaaatcgaaaaccatcaaccataaaatagatgggattgataaatattttttagaaattaaatctgaaataaaaagttcgcattttattatggatgctttatcaaatgaattagttaattcaaaattaattttgattaaattaaatattcgctcttccgttacgcaatgtgaatattttaacctttatggagaaaataattatgacgacttgcttgaactatcgcaacggcttgaaaaattagattgtgtcagctactgctgcatctgccccaacacaacaggctaccacccccccaaactccctataaatagccaaactattgaagaaaagattagcagtgatgagataacccccgatttcaccgagttacaaaaatatttagatgcaccaatgggcatgaatgtgagagaggcatgggcaaaaaatattgatggctcgctagcggttgttcgccatatggattttggtgtataccaaaaccacgaagactttaaagatgcaaaccttgctgtggtaagtagtcggcctgaaacgcaagattgtaaccatggtaccgcttcaacaggttgcataattgcgactaaaaatgaatttggtgtcactggcattgcacatggttgccaattttatttctatgataccgacgacttggatcaacttacggatgatactcagccgggtgacattgttagtttcgacctccaatttcgcattgagaataaattgcttcctatcacatccatccgtaattggtgggaaagaattaaaattatggtcgataaaggtgcaaccgttcttctagcagcagggaatggtggcttggatttaagcaaacccgaggttatggatgatttcggtgacaatggcagcatgttagtaggcgcttgctaccaccatacagggaaacgtgcgcttttttcaaattataatcaaacaagctcactgattaattcatggggagattggagtgtgaccaccacaggctatggaaaactacaaaaacaccccggcaatgaacgcaattataccgaccgttattcaggaacatcgagtgcaacaccactatgttcaggtgcactcgcattaattcaaagctaa

SEQ ID NO: 321 - DNA, 1656 bp, custom Sp.
atgaaaaccaaaatcaacctgttcgcgctgttcgcgttctgctcttctctgtctttcggtcaggactctcagcaccgtatggcgaacgaccagaactctgttatctacgtttgcttctctaaaggtatcaactctgaaaaagcggcgttctctcgtaacgcggacctggaacgtttctctcgtgaaaaccacatctctttcaaatacgacctggacttcaccgacaacaaactggacgaaatggcgcgtaactctaaagcgatcggtaactctaccgaatctgttgaaaaactgaaacgtatctacaaagcggacctgccgctgcagtctaccgaaaccgcggaaaaaatcatccgtaccctggaacgtttcccggaaatcgaatacgtttctgttatgtctgcggaaccggttgaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaactctggtctggcgaacaacaactaccgtgacgcgggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgaccaggttatctgggacctgaccaaagcggcgaccgactctggtatcatcatcatcgcggcggcgggtaacggtaaccagaacctggacgacccgttctacgcgaactacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagtacctgaccccggcggcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctgcgctggaagttaaaatctacccgaacccgtcttcttcttctatcgcgatccagtctaacgaaaacaaaaaactggacatcgaaatcatcaacctgcagggtcgtaccgttatcaaatcttctgttctgtctcacgaaaaaatcgacatctctcagctgccggcgggtcagtacatcatcaacatcaacgaaggtcagcgtcgtgttgttgaaaaactgaccaaaatc

SEQ ID NO: 322 - DNA, 1635 bp, custom Sp.
atgaaaaccaaaatcaacctgttcgcgctgttcgcgttctgctcttctctgtctttcggtcaggactctcagcaccgtatggcgaacgaccagaactctgttatctacgtttgcttctctaaaggtatcaactctgaaaaagcggcgttctctcgtaacgcggacctggaacgtttctctcgtgaaaaccacatctctttcaaatacgacctggacttcaccgacaacaaactggacgaaatggcgcgtaactctaaagcgatcggtaactctaccgaatctgttgaaaaactgaaacgtatctacaaagcggacctgccgctgcagtctaccgaaaccgcggaaaaaatcatccgtaccctggaacgtttcccggaaatcgaatacgtttctgttatgtctgcggaaccggttgaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgaccaggttatctgggacctgaccaaagcggcgaccgactctggtatcatcatcatcgcggcggcgggtaacggtaaccagaacctggacgacccgttctacgcgaactacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagtacctgaccccggcggcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctgcgctggaagttaaaatctacccgaacccgtcttcttcttctatcgcgatccagtctaacgaaaacaaaaaactggacatcgaaatcatcaacctgcagggtcgtaccgttatcaaatcttctgttctgtctcacgaaaaaatcgacatctctcagctgccggcgggtcagtacatcatcaacatcaacgaaggtcagcgtcgtgttgttgaaaaactgaccaaaatc

SEQ ID NO: 323 - DNA, 1656 bp, custom Sp.
atgaaaaccaaaatcaacctgttcgcgctgttcgcgttctgctcttctctgtctttcggtcaggactctcagccgaaaatggcgaacgaccagaactctatcatctacgtttgcttctctaaaggtatcaactctgaaaaaaccgcgttctctcgtaacgcggacctggaacgtttctctcgtgaaaaccacatctctttcaaatacgacctggacttcaccgactctaaactggacgaaatggcgcgtaactctaaagcgatcggtaactctggtgaatctgttgaaaaactgaaacgtatctacaaagcggacctgccgctgcagaacaaagaaaccaccgaaaaaatcatccacaccctggaacgtttcccggaaatcgaatacgtttctgttatgtctgcggaaccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgacctacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctgcgctggaagttaaaatctacccgaacccgtcttcttcttctatcgcgatccagtctaacgaaaacaaaaaactggacatcgaaatcatcaacctgcagggtcgtaccgttatcaaatcttctgttctgtctaacgaaaaaatcgacatctctcagctgccgaccggtcagtacatcatcaacatcaacgaaggtcagcgtcgtgttgttgaaaaactgaccaaactg

SEQ ID NO: 324 - DNA, 1656 bp, custom Sp.
atgaaaaccaaaatcaacctgttcgcgctgttcgcgttctgctcttctctgtctttcggtcaggactctcagccgaaaatggcgaacgaccagaactctatcatctacgtttgcttctctaaaggtatcaactctgaaaaaaccgcgttctctcgtaacgcggacctggaacgtttctctcgtgaaaacaaaatctctttcaaatacgacctggacttcaccgactctaaactggacgaaatggcgcgtaactctaaagcgatcggtaactctggtgaatctgttgaaaaactgaaacgtatctacaaagcggacctgccgctgcagaacgaagaaaccacccagaaaatcatccacaccctggaacgtttcccggaaatcgaatacgtttctgttatgtctgcggcgccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgacctacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctccgctggaagttaaaatctacccgaacccgtcttcttcttctatcgcgatccagtctaacgaaaacaaaaaactggacttcgaaatcatcaacctgcagggtcgtaccgttatcaaatcttctgttctgtctaacgaaaaaatcgacatctctcagctgccgaccggtcagtacatcatcaacatcaacgaaggtcagcgtcgtgttgttgaaaaattcaccaaactg

SEQ ID NO: 325 - DNA, 1656 bp, custom Sp.
atgaaaaccaaaatcaacctgttcgcgctgttcgcgttctgctcttctctgtctttcggtcaggactctcagccgaaaatggcgcaggaccagaactctatcatctacgtttgcttctctaaaggtatcaactctgaaaaaaccgcgttctctcgtaacgcggacctggaacgtttctctcgtgaaaacaaaatctctttcaaatacgacctggacttcaccgacaacaaactggacgaaatggcgcgttcttctaaagcgatcggtaactcttctgaatctgttgaaaaactgaaacgtatctacaaagcggacctgccgctgcagaacgaagaaaccacccagaaaatcatccactctctggaacgtttcccggaaatcgaatacgtttctgttatgtctgcggcgccgatcgaaccgccgctggttaacgcgttcgttgcgaccccggacctggaatctatccagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgacctacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagaacctgaccccgtctgcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctccgctggaagttaaaatctacccgaacccgtcttcttctaccatcgcgatccagtctaccgaaaacaaaaaactggacttcgaaatcatcaacctgcagggtcgtaccgttatcaaatcttctgttctgtctgacgaaaaaatcgacatctctcagctgccgaccggtcagtacatcatcaacatcaacgaaggtcagcgtcgtgttgttgaaaaattcaccaaactg

SEQ ID NO: 326 - DNA, 1659 bp, custom Sp.
atgaaaacaaaaatcaaccttttcgcattatttgcgttctgttctactctgtctttcggacaggacagccagcccaaaatggctaatgatcaaaattcaattatttacgtatgcttttcaaaaggcatcaattcagaaaaaacagctttcagcagaaacgctgatctggaaagattttcaagagaaaaccatatctcatttaagtatgatctggattttacagacagcaaacttgatgaaatggccagaagcagcaaagccatcggtaattccggagaatctgtggaaaagctgaaaagaatctataaggccgatattcctcttcaaaataaagaagcttcagaaaaaatcatccatactcttgagagatttcctgaaatagaatatgtatctgtaatgagtgccgaacctatcgaaccaccattagtcaatgcttttgtggccactcctgatctggaaagcctgcagacttatctgaatgacaatccgggaatcaacgccaaatatgcatggtcaagaggaatcacaggacagaatatccgtgtacgagatgtagaatacgggttctacaagactcacgaaatgctgtctaatcaaaactctatacagcttgaacctggttattcacctaatgcaggattagccaataataattaccgtgaccacggaacagcagttgtgagtattttaggttcaataaaagataatatcggacttacaggagctgcttatagtgcttctgaaataaaaggttatatggaatggactacggtgggatacaacagagcttctgcggtaagcagatctattaatgcatctcaggccggagatattatattatacgaaatgcagactggtggaaaagacggtcagtattgccctgcggaatatgacaaagtaatctgggatcttacgaaagctgctactgattcaggaattattatcattgcagcggcaggtaatggaaaccaaaatctggatgatccgttttatgcaacctatcttgcgagaggaaacagtggtgctatcattgtaggagcaggatctcctaatactacccattcaaaattaagcttcagtacatttggaaacagagtggatgttcagggttggggaagcagtgtgatggcagcaggctatggatcttatgcgaaatatgacaatgacaacaacagaacttataattatttcagcggtacaagttctgcaacacctgtggtttcttctgcagctattttgattcagtctttctatcgccagactacaggtcaatatttaacaccttcagcgatgaaaaaccttttaatttcaacaggaattcctcagggaggaacagtgacggggcaaaagatcggacctcttcctaatgtgaagaatgctatccttcaactggaaagtaattttgtagcacctgttaagactttaccatcattagaggttaaaatttatcctaatccatccagcagttccattgctattaaaagcagtgaaaataaaaaactggatatagagattattaaccttcagggacgtacagtgattaaaaattcggttttaccgaatgaaaagattgatatttcacaacttcctacggggcagtatatcatcaatattaatgaaggccagagaagagttgttgagaaattaaccaaactctaa

SEQ ID NO: 327 - DNA, 1659 bp, custom Sp.
atgaaaacaaaaatcaaccttttcgcattgtttgcgttctgctcttccctgtcttttggtcaggaaagccagcccaaacttaatcaggatcaaaattcaatcatctatgtatgcttttcaaaaggcatcaattcagaaaaaactgcattcagcagaaatgctgatctggagagattttcaagagaaaataacatttcatttaagtacgatctggattttacagaccgcaaacttgatgaaatggccagaaacagcaaagcaattggaaactcctcagaatctgtagaaaagctgaaaagaatttataaggctgatctgcctcttcaaaacgaagaaactactcaaaaaatcattcacagtcttgaaagattccctgaaatagaatatgtatctgtgatgagtgcggctcctattgaacctcctttggtaaatgcttttgtagccacacctgatctggaaagtattcagacttatctgaatgacaatccgggaatcaatgcaaaatatgcttggtcaagaggaatcaccggacagaatattcgtgtaagggatgttgaatatggtttttacaaaactcatgagatgcttaccaaccaaaattctatacagcttgaaccgggatattctccgaatgcaggattagctaataataactaccgtgaccacggaactgcagtggtgagtattttaggttcaataaaagataacatcgggcttacgggtgctgcctacagtacttctgaaataaaaggatatatggaatggaccactgtgggatacaacagagcatctgccgtaagcagatctattaatgcttcccagtcaggcgacattattttatatgaaatgcagacaggaggaaaagacggccagtattgtcctgcagagtatgataaagtaatctgggatcttacgaaagcagctaccgattcaggaattattatcattgccgctgcaggtaacggaaatcagaatctggatgatccgttttattcaacttatcttgccagaggaaatagcggtgctatcattgtaggagcagggtctcccaataccacccattcaaaattaagcttcagtacttatggaaacagagtggatgttcagggctggggaagcagtgttcttgctgcaggctatggttcttatgccaaatatgataatgataacaacaggacttataattattttagcgggacaagttctgcaacacctgtagtatcttctgcagctattttaattcagtctttctatcgtcagactacaggtcagaacctgacaccctctgcgatgaaaaacctcttgatttctacaggaattcctcagggaggaactgtaaccggtcagaaaatcggacctcttcctaatgtaaaaaatgcgatactgcaattggaaagtaaatttgctacccctgtaaaaacattgtctccgctggaggttaaaatctaccctaatccatccagcagtactcttgctattcaaagtacagaaaacaaaaagctggattttgaaatcatcaatcttcaggggcgtacagtgatcaaaagtgctgttttgcctaatgaaaaaattgatatttcacaactgccaatgggtcaatatatcatcaatattaatgaaggccaaagaagggttgttgagaaattcacaaaactataa

SEQ ID NO: 328 - DNA, 1665 bp, custom Sp.
atgaaaaccaaaattcaattgtttgctttgtttaccttttgctcatcattgtcatttggtcaaaatccacaaaatcaaccaaatcgtaataatgatcaaaattcaaatatttatgtttgcttttcaaaaggtattaattcagaaaaagctgctttttcacgtaattcagatttggaacgttttgctcgtgaaaataaaatttcatttacctatgatttggattttaccgattcaaaattggatgaaatggctcgttcatcaaaagctattggtaattcaggtgaatcagttgaaaaattgaaacgtatttttaaagctgatttgccattgcaaaatgaagaaaccacccaaaaattgattcaaaccttggaacgttttccagaaattgaatatgtttcagttatgtcatcaaccccaattgaaccaccattggttaatgcttttgttgctaccccagatttggaatcattgcaaacctatttgaatgataatccaggtattaatgctaaatatgcttggtcacgtggtattaccggtcaaaatattcgtgttcgtgatgttgaatatggtttttataaaacccatgaaatgttggctaatcaaaattcaattcaattggaaccaggttattcaccaaattcaggtttgtcaaataataattatcgtgatcatggtaccgctgttgtttcaattttgggttcagttaaagataatattggtttgaccggtgctgcttattcagcttcagaaattaaaggttatatggaatggaccaccgttggttataatcgtgcttcagctgtttcacgttcaattaatgcttcacaagctggtgatattattttgtatgaaatgcaaaccggtggtaaagatggtcaatattgcccagctgaatatgataaagttatttgggatttgaccaaagctgctaccgattcaggtattattattattgctgctgctggtaatggtaatcaaaatttggatgatccattttatgcttcatatatggctcgtggtaattcaggtgctattattgttggtgctggttcaccaaataccacccattcaaaattgtcattttcaacctatggtaatcgtgttgatgttcaaggttggggttcatcagttttggctgctggttatggttcatatgctaaatatgataatgataataatcgtacctataattatttttcaggtacctcatcagctaccccaaccgttgcttcagctgctattttgattcaatcattttatcgtcaaaccaccggtcaatatttgaccccatcagctatgaaaaatttgttgatttcaaccggtattccacaaggtggtaccgttaccggtcaaaaaattggtccattgccaaatgttaaaaatgctattttgcaattggaatcaaaatcagctacctcagttaaaaccttgccatcattggaagttaaaatttatccaaatccatcaacctcatatattgctattcaatcatcagaaaataaaaaattggattttgaaattattaatatgcaaggtcgttcagttattaaatcatcagtttcatcagatgaaaaaattgatatttcacaattgccaaccggtcaatatattattaatattaatgaaggtcaacgtcgtgttgttgaaaaatttaccaaattgtaa

SEQ ID NO: 329 - DNA, 1653 bp, custom Sp.
atgaaaaccaaaatcaaactgttcgcgctgttcatgttctgctgctctctgtctttcggtcagaaaccgtctaacggtgacatcggtcagaacgcgaacatctacgtttgcttctctaaaggtatcaactctgaaaaagcggcgttctctcgtaacccggaactggaacgtttcgcgcgtgaaaacaaaatctctttcacctacgacctgggtttcaccgacgaaaaactggacgaaatggcgcgtaactctaaactgaacggtaactctggtgaatctgttgaaaaactgaaacgtatcttcaaagcggacctgccgctgcagaacgaagaaaccgcgcagaaactggcgcaggcgctggaacgtttcccggaaatcgaatacgtttctgttatgtcttctaccccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctggcgaaccagaactctatccagctggaaccgggttactctccgaactctggtctgtctaacaacaactaccgtgaccacggtaccgcggttgtttctatcctgggttctgttaaagacaacatcggtctgaccggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgtcttacatggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccgaccgttgcgtctgcggcgatcctgatccagtcttactaccgtcagaccaccggtcagtacctgaccccggcggcgatgaaaaacctgctgatctctaccggtatcccgcagggtggtaccgttaccaaccagaaaatcggtccgctgccgaacgttaaaaacgcgatcctgcagctggaatctaaatctgcgaccccggttaaagcgctgccgccgctggaagttaaaatctacccgaacccgtctaccaactacatcgcgatccagtctaacgaaaacaaaaaactggacttcgaaatcatcaacatgcagggtcgttctgttatcaaaggttctgtttcttctgacgaaaaaatcgacatctctcagctgccgccgggtcagtacatcatcaacatcaacgaaggtcagcgtcgtgttgttgaaaaattcaccaaactg

SEQ ID NO: 330 - DNA, 1665 bp, custom Sp.
atgaaaacaaaaatccaacttttcgcattgttcacattctgtgcgtccctctcttccggtcaaaatcaaaaaaatcagcttaatcagaacattggtcagaatgctgccgtttatgtatgtttttctaaaggaatcaattctgaaaaggccgctttcagcagaaattcagatctggaaagatttgcaagggaaaataaaatctcatttgcctatgaccttgatttcacagattctaaactggatgaaatggcccgaagcagcaaagcaatcgggaattccggagaatctgtggaaaagctgaagcgcatattcaaagcagatcttcctctgcaaaatgaagcgacaactcaaaaacttattcagacccttgaaagatttcctgaggtagaatatgtatccgtaatgagtggtactcctgtagaacctccattggtaaacgctttcgtagttacccctgatctggaaagcgttcagacttatctgaatgacaacccgggaatcaatgcaaaatatgcatggtcaaggggcatcaccggacagaatatccgggttcgggatgtggaatatgggttttataaaacgcatgagatgctggctaaccaaaactctattcaactggaaccgggatattctcctaattccggattatccagtaataattaccaagatcacggcaccgcagtagtaagtatcctgggctcggtaaaagacaatataggacttacaggagcagcctacagtgcttccgagataaaaggttatatggaatggacaacggtgggatacaacagagcttctgcagtcagcagatccatcaatgcatcccaggccggagatattatcctgtatgaaatgcagaccggcggaaaagacggccaatattgccctgccgagtatgacaaagtgatatgggatcttaccaaagctgctactgattccggaattattatcattgcagcagccggtaacggaaatcagaatctggatgatcctttttatgctccttacatggccagaggaaacagtggagctattattgtaggagcgggatcgcccaatacgacccattcaaaattaagcttcagtacttttggaaacagagtggatgtacaaggctggggaagcagtgttctggcagcgggctacggttcttacgccaaatatgataacgataacaacagaacttacaattatttcagcggtacaagttctgcaacgcctacagtagcttcagcagccattctgatccagtcattctaccgtcagacaacaggacagtatctgactccttctgcgatgaagaatcttctgatctctaccggaattccacaaggtggtactgttacaggacaaaaaataggacctttacctaatgtaaaaaatgctatcttaaaacttgaaagcggatctaagggcaaaactgaaagcctgccttctttggctgtaaagatctaccctaacccttctaccacttatatcgctattcaaagtaatgaagataaaaggctggattttgaaatcattaatatccagggaagaagtattctgaagaattcggtttcttctgatgagaagatcgacatttcacaacttcctagaggccagtatatcatcaatattaacgaaggagcaagaagagtggtagagaaattcaccaaattataa

SEQ ID NO: 331 - DNA, 1653 bp, custom Sp.
atgaaaaccaaaatcaaactgttcaccctgctgctgttctgcttcttcctgtctttcggtcagaacccgtctgaccgtggtatcggtcagaactctaacatctacgtttgcttctctaaaaacatcaactctgaaaaagcggcgttctctaaaaacccggaactggaagaattcgttcgtgaaaacgacatctctttcgtttacgacctgggtttctctgaccgtaaactgaacgaaatggcggcgaactctcgtctgaacggtaactctggtgaatctgttgaaaaactgaaacgtatcttcaaagcggacgttccggttcagaacaacgaaaccgcgcagaaactggcgcaggcgctggaaaaattcccggaaatcgaatacgtttctgttatgtcttctaccccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctggcgaaccagaactctatccagctggaaccgggttactctccgaactctggtctgtctaacaacaactaccgtgaccacggtaccgcggttgtttctatcctgggttctgttaaagacaacatcggtctgtctggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgactctgttatctgggacctgaccaaagcggcgaccgactctggtatcatcatcatcgcggcggcgggtaacggtaaccagaacctggacgacccgttctacgcgtcttaccgtgcgcgtggtaactctggtgcgatcatcgttggtgcgggttctccgaacaccacccactctaaactgtctttctctacctacggttctcgtgttgacgttcagggttggggttctaacgttctggcggcgggttacggttcttacgcgaaatacgacaacgacaacaaccgtacctacaactacttctctggtacctcttctgcgaccccggttgttgcgtctgcggcgatcctgatccagtcttactaccgtcagaccaccggtcagtacctgaccccggcggcgatgaaaaacctgctgatctctaccggtatcccgcagggtggtaccgttgttaaccagaaaatcggtccgctgccgaacgttaaaaacgcgatcctgcagctggaatctaccctgaccctgtctaccaaaaccctgccgccgctggaagttaaaatctacccgaacccgtctaccaactacatcgcgatccagtctaaagaaaacaaaaaactggacttcgaaatcatcaacatgcagggtcgttctgttatcaaaggttctgtttcttctgacgaaaaaatcaacatctctgacctgccgccgggtcagtacatcatcaacatcaccgaaggtcagcgtcgtgttgttgaaaaattcaccaaactg

SEQ ID NO: 332 - DNA, 1656 bp, custom Sp.
atgcgtaccaaaatccgtctgttcaccctgttcatcttctctttcttcctgtctttcggtcagaacccgtctaaccagctggacaaatctcagaactctaacatctacgtttgcttctctaaaaacatcaactctgaaaaagcggcgctgtctaaaaacccggaactggcggaattcgttaaaaccaacgacatctctttcgttaacgacctgggtttctctgaccgtaaactggacgaaatgatcaaaaactctcgtgcgaacggtaactctggtgaatctgttgaaaaactgaaacgtatcttcaaagttaacatcccgctgcagaacaacgaagacgcggaaaaactggcgcgtaccctggaaaaattcccggaagttgaatacgtttctgttatgtcttctaccccgatcgaaccgccgttcgttaaagcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctgtctaaccagaactctatccagctggaaccgggttactctccgaacgcgggtctgtctaacaacaactaccgtgaccacggtaccgcggttgtttctatcctgggttctgttaaagacaacatcggtctgtctggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgactctgttatctgggacctgaccaaagcggcgaccgactctggtatcatcatcatcgcggcggcgggtaacggtaaccagaacctggacgacccgttctacgcggcgtaccgtgcgcgtggtaactctggtgcgatcatcgttggtgcgggttctccgaacaccacccactctaaactgtctttctctacctacggtaaccgtgttgacgttcagggttggggttctaacgttctggcggcgggttacggttcttaccagaaatacgacaacgacaacaaccgtacctacaactacttctctggtacctcttctgcgaccccggttgttgcgtctgcggcgaccctgatccagtcttactactaccagaccaccggtcagtacctgaccccggcggcgatgaaaaacctgctgatctctaccggtatcccgcagggtggtaccgttgttaaccagaaaatcggtccgctgccgaacgttaaaaacgcgatcctgcagctggaatcttctctggcggcgaaaaccaaagttccgctgccgctggaaatcaaaatctacccgaacccggcgacctcttacatcgcgatccagtctaacgaatctaaaaaactggacttcgaaatcatcaacatgcagggtcgtaccgttaccaaaggttctgtttctccggacgaaaaaatcaacacctctaacctgccgaccggtcagtacatcatcaacatcaccgaaggtcagcgtcgtgttgttgaaaaattcaccaaactg

SEQ ID NO: 333 - DNA, 1662 bp, custom Sp.
atgcgtaccaaaatccgtctgttcaccctgctgctgttctctttcttcctgtctttcggtcagaacccgtctgacaaaaccgaccagcagaactctaacatctacgtttgcttctctaaaaacatcacctctgaaaaagcggcgctgtctaaaaacccggaactggcggaattcgttaaaaccaacgacatctctttcgttaacgacctgggtttctctgaccgtaaactggacgaaatgatcaaaaactctcgtgcgaacggtaactctggtgaatctgttgaaaaactgaaacgtatcttcaaagttaacctgccgctgcagaacaacgaagaagcggaaaaactggcgcgtaccctggaaaaattcccggaagttgaatacgtttctgttatgtcttctaccccgatcgaaccgccgttcgttaaagcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctgtctaaccagaactctatccagctggaaccgggttactctccgaacgcgggtctgtctaacaacaactaccgtgaccacggtaccgcggttgtttctatcctgggttctgttaaagacaacatcggtctgtctggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgactctgttatctgggacctgaccaaagcggcgaccgactctggtatcatcatcatcgcggcggcgggtaacggtaaccagaacctggacgacccgttctacgcgtcttaccgtgcgcgtggtaactctggtgcgatcatcgttggtgcgggttctccgaacaccacccactctaaactgtctttctctacctacggtaaccgtgttgacgttcagggttggggttctaacgttctggcggcgggttacggttcttaccagaaatacgacaacgacaacaaccgtacctacaactacttctctggtacctcttctgcgaccccggttgttgcgtctgcggcgaccctgatccagtcttactactaccagaccaccggtcagtacctgaccccggcggcgatgaaaaacctgctgatctctaccggtatcccgcagggtggtaccgttgttaaccagaaaatcggtccgctgccgaacgttaaaaacgcgatcctgcagctggaatctaccctgctgctgaaaaccaaaaaaaccgaaaccccgctgccgctggaaatcaaaatctacccgaacccgtctacctcttacatcgcgatccagtctaaagaatctaaaaaactggacttcgaaatcatcaacatgcagggtcgtaccgttcgtaaaggttctgtttctccggacgaaaaaatcaacacctctgacctgccgccgggtcagtacatcatcaacatcaccgaaggtcagcgtcgtgttgttgaaaaattcaccaaactg

SEQ ID NO: 334 - DNA, 1656 bp, custom Sp.
atgaaaacaaaaattaaacttttctctttgtttatgttctcctgttctctctgtcttgcacagaaaccttcaaacggagactcttatgcaaaagccaatatctatgtctgtttttcaaaaggtattgcttcagcaaaagctgcatttgcacaaaaccctgagctggaaaaattggccagggaaaacagcatgtcatttacctatgaccttggctttactgatgaaaaactttctgagatggcaagaaacagtaagctcaacggttattctcctgaatctgtcgaaaaactgaaaagaatattcaaagctgaccttccccttcaaaatgaagaatatgcccaaaggctggctcaggctcttgaaagatttcctgaagttgaatatgcatcagtaatgagcagtactcctgtagaacctccattaatcaatgcttttgttgcaactcctgatctggaaaaccttcagacttacctgaacgacaaccccggaatcaatgccaagtatgcctggtcgagagggattaccggacaaaatataagaatccgtgatgtagaatacggtttttataaaactcacgaaatgcttgtcaatcaaaactcaatacaactggaaccaggatattctccaaattccggattatcaaataataattaccgagatcacggtactgctgtagtcagtattttaggttctgtaaaagataatatcggacttacaggagcagtctacaatgcttctgaaatcaaaggatatatggagtggaccactgtaggctacaacagggccgctgcagtgagcagatccatcaatgcatcccaggccggcgatattatcctgtatgaaatgcaaaccggcggtaaagacggtcaatattgccctgcagaatatgacaaagtaatctgggatcttacaaaggcggctacagattcagggataatcattattgcagcagcaggtaatgggaaccagaaccttgatgatcctttctatgcttcttatatgtcaagaggaaacagcggtgctattatcgtgggagctggttcaccaaataccacacattcaaaactaagtttcagcacatacgggaaccgggtggatgtacaaggttggggaagcagtgttctggcggcaggatatggttcctatgccaaatatgataatgataacaacagaacatacaattacttcagtggaacaagctctgcaactcctacggtagcttctgccgcggtgctgattcagtcatattatcgccaaaccacaggtcagtacctgagtccggctgccatgaagaaccttttaatttctacaggaataccccagggtggcactgttgccaatcaaaaaatcgggcctcttcccaatgtaaaaaatgccatactccaattggaaggcaaatcggcaacggctgttaaagctttaccatcattggaagtaaaaatctatcctaatccgtcccaaaatgttataacccttcaaaatgtggaaaataaaaagcttgattttgaaatcattagtatgcagggacgatctgtcatcaggggaacagcaatgccggaagaaaaaattgatctttcaagcctgttgcccggacaatatattattacgatcagtgaagggcaacgaagagttgttgaaaaactgataaagcaataa

SEQ ID NO: 335 - DNA, 1656 bp, custom Sp.
atgaaaacaaaaatcaaactccttacactattggtgttctgtttcttcctttcatttggacaatctccatcagatcgcagcgcgaaacaaaatgatctgatttatgtatgtttttcaaagaatatctcttcagacaaggatgcacttagtaaaaatccggaactggaaagatttgccagagaaaatggaatatcatttacttatgatctgggattcagcagtgaaaaaattaatgaaatgatggccaacagcagacgaaacggaaattcgggggagtctgttctaaaactgaaaagaatatttaaagccaatgttcctgttcagaatggcgatacttttcaaaggctagttcaaagccttgaaaaattcccggaaatagaatatgtatcagtaatgagtagcactcctattgaaccacctttagttaatatgtttgtcgcaactccggatctggaaagcatacagacttacctgaatgacaacccgggaatcaatgcaaaatacgcatggtcaagaggaatttccgggcagaacatccgtatacgcgatgtagaatatggtttttacaaaactcacgaaatgctgaccaatcagaactcaatccaattggaaccgggatattctcccaattcaggattagccaataataattaccgggatcatggaacggctgtagtaagtattttaggatccataaaagataatatcggacttactggtgctgtttacagtgcttcagaaatcaaagggtatatggaatggactactgttgggtataacagagccactgcggtaagcagatccatcaacgcttctcagtcgggagatatcatcctgtatgaaatgcagactgggggaaaagacggtcaatattgccctgccgaatatgacagtgtgatctgggatcttacaaaggcagctacagattcaggaattatcatcattgcagcagcagggaatgggaatcaggaccttgatgatcctttctatgcgcagtacagagcaagaggaaacagcggtgctatcatcgtaggtgccggtactcctaatactacgcactcaaaacaaagtttcagtacttatggaagccgagtggatgtacagggatggggaagcagtgttctggcagcaggctatggatcgtatgcaaagtatgataacgataataacaggacttataattatttcagcggaaccagttctgcgacacctactgtagcttctgctgctgtgcttattcaatctttttaccgtcagactacaggacagaatttaagcccggctgctatgagaaaccttttagtttctacaggaattccacagggaggaactgatgttaataaaaaaataggtccgcttccgaatgtaagaaacgctattttacaactggaaagtaaatctacagtttcagctaaagctttacctgcccttgaagtgaaaatttaccctaatccatccagcaattatatcgctattcagaatactgaagataaaaaaatggatatcgaaattatcaatatgaatggaagatcagtgataaaaagcacagtttcttccggagaaaaaattaatatttctgaacttcccgttggtcagtatctcatcaatatcaatgaaagatcaagacgtgttgtggagaaattcaccaaactataa

SEQ ID NO: 336 - DNA, 2046 bp, custom Sp.
atggttaccttcttcatcaaaatgaaaaccaaaatcaacctgttcgcggttctgttcgcgttctgctctatctactctctgtctttcggtcaggactctctgccgaccaacccgccgggtgaactgctgtctaacgacgttctgctgggttacccgtctatcggtctgaaaaaccagcagccgaaaatggcgaacgaccagaactctatcatctacgtttgcttctctctggaagcggaaaacggtaaaggtatcaactctgaaaaaaccgcgctgggtaactacaccttctctcgtatcaccgaattcgacctgctgttcgacatcgactctatcatcgaagaagttctgaaagacttcggtaaagacgcggaatacccgttcctgccgccgaaacgtaacgcggacctggaacgtttctctcgtctgaacgcggcgggtaacaaaggtgaaaaccacatctctttcaaatacgacctggacttcaccgactctaaactggacgaaatggcgcgtgaaaaattcgactctctgccggttttcctggcgatcaaaaacaaactgggtatcaaaccggttttcgacaaaaaaaactctaaagcgatcggtaactctggtgaattctctgttgaaaaactgaaacgtatctacaaagcggacctgccgctgcagaacaaagaaaccaccgaaaaaatcatccacaccctggaacgtttcccggaaatcgaatacgtttctgttatgtctgcggaaccgatcctggaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggactacgacccgccgttctacgcgacctacctggcgcgtggtaactctggtgcgatcatcgttggtgcgggttctccgaacaccacccactctaaactgtctttctctacctacggtaaccgtgttgacctggttcagggttggggttcttctaccgttctggcggcgggttacggttcttacgcgaaatacgacaacgacaacaaccgtacctacaactactgcttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctgcaggaatctaaattcgcgaccccggttaaaaaaaccgaaaccctgtctgcgctggaagttaaaatctacccgaacccgtcttcttcttctatcgcgatccagtcttctgaaggtgttaacaaaaaactggacatcgaaatcatcaacctgcagggtcgtaccgttatcaaatcttctgttctgccgaacaacgaaaaaatcgacatctctcagctgccgaccggtcagtacatcatcaacatcaacgaaggtcagcgtcgtgttgttgaaaaactgaccaaactggttaaa

SEQ ID NO: 337 - DNA, 1653 bp, Chryseobacterium Sp.
atgagaacaaaaattagacttttcacattatgtattttcattttcgtgttttcattcgggcagaaaaccgatcaattaagttctaacatttatgtgtgcttctcaaaagatgtcagttctgacaaagaggcgctcagtaaaaaccctgctttagcagaatttgtcaaaacaaatgacatttcattcgttaatgatcttggcttcagtgagaggaaacttgaggaaatgatggcaagcagcagagcaaacggtaattcgggcgaatccgttcaaaagctgaaacgcatcttcagagtcagtcttcctttcctgaatcacgaggaagctgaaagaacagcccgtactcttgagaagtttccggaagtagaatatgtttccgtaatgagcagcactcccattgaacctccattcgttaaagcttttgtgactaccccggatcttgaaagccttcagacttacctcaacgacaatcccgggatcaacgcaaaatatgcatggtccagaggaattacagggcaaaatatccggattcgtgatgtagaatacggcttttacaaaactcacgaaatgctctccaatcagaactctatacaactggaaccgggatattcacctaattcgggattatcaggtaacaattacagggatcacgggactgctgtggttagtattttaggttccgtgaaagataatatcgggctttccggtgccgcttacagcgcatcagaaatcaaaggatatatggaatggactactgtgggctataacagggctaccgcagtaagcagatcgatcaatgcatcgcaggccggcgatattattttatacgaaatgcagacaggaggaaaagacggccagtactgcccagctgaatacgacagtgtgatctgggatctgacaaaagcagctaccgattccggaatcattattattgcagcagcaggaaacggaaatcagaatctggatgatcctttttatgcttcttacatggcaagaggaaacagcggggctattatcgtaggggcaggttcttccaacactactcactctaaactgagcttcagtacctacggaaaacgcgtggatgtacagggttggggaagtaatgtcctggctgccggatacggctcgtatcaaaaatatgataacgataataacagaacatataattatttcagcggaacaagctctgctactccagttgtagcatcggcagctactttgatccagtctttttaccggcaaactacaggtcagtatttgactcctgctgctatgaagaatcttttaatatcaacaggaatccctcagggaggtaccgttgccaatcaaaaaataggaccttttcctaatgtaaaaaatgccatattacagctggaaagtagttctttactcaaatccaataaggctgaggttcctcttcctttagaagttaagatttatccgaatcctgtaaccagccatatcaccatccacagcagtgatagtaaaaaactggattttgaaattatcaatatgcagggaagaactgtcagaaagggatctgccttacctgatgaaaagatcggaactgcagatcttcttccaggccagtatatcatcaatattacagaaggacaaagaagagtggttgaaaaattcactaaattataa

SEQ ID NO: 338 - DNA, 1728 bp, unknown
  environmental sample
gtgatttgttttcattttattattatttttgatattattcagacttattcacaaccatttaataaaaataatatgaaaacaaaaatcaaattctttactctctttgtattctgttttttcctttcatttgcacaatctccatcagatcgcagtgctccgcaaaacgatctgatctatgtatgttttgcaaaaggtatttcttcagaaaaagatgcactcagtaaaaatcctaaactggaaagatttgtgaaggaaaatagaatatcttttacttatgatctaggttttagcaatgaaaaaattaatgaaatgattgctagcagcagattgaacggaaattccgaagagtctgttcaaaaactgaaaaggatattcaaagcggatattcctgttcaaaatggcgatgctttccaaagacttactcaaatccttgaaaaattccctgaaatagaatatgtatctgtgatgagcagtactcctgttgaaccacctcttgtcaatatgtttgtagcaacacctgatctggaaaatcttcaaacgtatctgaatgacaatccgggaatcaatgcaaaatacgcatggtcaagaggaattaccggacaaaacatacgtatccgcgatgtggaatatggcttctacaaaactcacgaaatgctaacgaatcagaactccattcagctggaacctggatattctcctaattcaggattagcgaacaataattaccgggatcacggaacagctgttgtaagtattttagggtctataaaagataatatcggccttactggtgctgtctacaatgcttcggaaataaaaggatatatggaatggaccactgttggatataacagagcttcagcggtaagcagatcaattaatgcctcacaagccggagatatcattttatatgaaatgcagactggtggaaaagacggccaatattgtcctgctgaatatgacagtgtgatctgggatcttacaaaagcagcgacagattcagggatcatcatcattgcggcagcaggaaatgggaatcaggaccttgatgaacctttctatgcaacgtacagagcaagaggaaacagcggcgccatcattgtaggagccggaactcctaacactacccattcaaagcaaagcttcagcacttacggaagcagagtggacgtacaaggatggggaagcagtgttctggctgcaggatatggatcgtatgcaaagtatgacaatgataataacagaacttacaattatttcagcggaaccagttctgcaacacctacagtggcttctgcagcggtactgattcagtctttttaccgtcagactacaggacagaatttaagtcctgctgctatgagaaatcttttggtttctacaggaattccacaaggagggactgatgtgaataaaaaaattggtccacttccgaatgtaagaaatgccattttacaactggaaggtaaatctacagcatccgctaaagccttacctgctttggaagtgaaaatttatcctaatccatccagcggctatatcgctattcaagctagcgaagataaaaaactggacattgaaattatcaatatgtatggaagatcagtgataaaaagtacggttgcttccgatgaaagaattaatatttcaaatcttcctactggtcagtatatcgttaatatcaatgaaggaacgagacgggtggtagagaagtttactaaattgtag

SEQ ID NO: 339 - DNA, 1671 bp, custom Sp.
atgaaaaaaaaaatcttcctgttcctgctgctgttctgcttcttcctgtctttcggtcagaaccgtaaaggtcagttccagctgcgtggtaactctcagaaccacaacctgtacgtttgcttctctaaaaacatcaactctgaaaaagacgcgatcggttactctaaaaacccggaattcaaagaattcgttcgtgaaaacgacatctctttcgtttacgacctgggtttctctgacaaaaaactgaacgaaatgctggcgaactctcgtctgaacaaaaactctggtgaatctgttgaaaaactgcgtcgtatcttcaaagttgaatctccggttcagaacaacgaagacatcctgaaactggcgcaggcgctggaaaaattcccggaaatcgaatacgcgtctctgctgtctaacaccccgatcgaaccgccgctgaccaacgcgttcgttgcgaccccggacctggaagcgctgcagacctacctgttcgacaacccgggtatcaacgttaaatacgcgtggtctcgtggtatcaccggtcagaacatccgtgttcgtgacgttgaatacggtttctacaaaacccacgaaatgctggcggaccagaactctatccagctggaaccgggttactctccgaacgcgggtctgtctaacaacaactggctggaccacggtaccgcggttgtttctatcctgggttctggtaaagacaacatcggtctgtctggtgcggcgtacaacgcgtctgaaatcaaaggtttcctggaatggaccaccgttggttacaaccgtgtttctgcggtttctcgtgcgatcaacgcgtctcaggcgggtgacatcgttctgtacgaaatgcagaccggtggtaaaaacggtcagtacgttccggcggaatacgacaacctgatctgggacctgaccaaagcggcgaccgactctggtatcatcatcatcgcggcggcgggtaacggtaacgaaaacctggacgacccgttctacgcgtcttaccgtgcgcgtggtaactctggtgcgatcatcgttggtgcgggttctccgaacaccacccactctaaactgtctttctctacctacggttctcgtgttgacgttcagggttggggtcagaacgttctggcggcgggttacggttcttacgcgaaatacgacggtgacaacaaccgtacctacacctacttctctggtacctcttctgcgaccccgatcgttgcgtctgcggcgatcctgatccagtcttactaccgtcagaccaccggtcagtacctgaccccggcggcgatgaaaaacctgctgatctctaccggtatcccgcagggtggtaccctggttaacaaaatcggtccgctgccgaacgttaaagcggcgatcgaacagctggaaaaaaccctgaccctgtctaccaaaaacaaaaccctgccgccgctgaaagttaaaatctacccgaacccggcgaccaactacatcgcgatccagtctccggaaaacaaaaaactggacttcgaaatcatcaacatggcgggtcgttctgttctgaaaggttctgtttcttctgacgaaaaaatcaacatctctgacctgccgaaaggtcagtacatcatcaacatcaccgacggtcagcgtcgtgttgttgaaaaattcatcaaactg

SEQ ID NO: 340 - DNA, 1518 bp, custom Sp.
atgaaaaccaaaatcaacctgttcgcggttctgttcgcgttctgctcttctctgtctttcggtcaggactctccgaccaacccgccgggtgaactgctgtctaacgacgttctgctgccgtctatcggtctgaaaaaccagcagccgaaaatggcgaacgaccagaactctatcatctacgtttgcttctctctggaagcggaaaacggtaaaggtatcaactctgaaaaaaccgcgctgggtaactacaccttctctcgtaacgcggacctggaacgtttctctcgtctgaacgcggcgggtaacaaaggtgaaaaccacatctctttcaaatacgacctggacttcaccgactctaaactggacgaaatggcgcgtggtatcaaaccggttttcgacaaaaaaaactctaaagcgatcggtaactctggtgaattctctgttgaaaaactgcgtatctacaaagcggacccgctgcagaacaaagaaaccaccgaaaaaatcatccacaccctggaacgtttcccggaaatcgaatacgtttctgttatgtctgcggaaccgatcctggaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaacatccagctggaaccgggttactctccgaacaactaccgtgaccacggtaccgcggttgtttctatcctgggttctatcaaagacaacatcggtctgaccggtgcggcgtactctaccaccaccgttggttacaaccgtgcgtctgtttctcgttctatcaacgcgtctcaggcgggtgacatcatcctgtacgaaatgcagaccggtggtgacggtcagtactgcccggcggaatacgacaaagttatctgggacctgaccaaagcggcgaccgactctggtatcatcatcatcgcggcggcgggtaacggtaaccagaacctggactacccgccgttctacgcgacctacggtaactctggtgcgatcatcgttggtgcgggttctccgaacaccacccacaaactgtctttctctacctacggtaaccgtgttgacctggttcagggttggggttcttctaccgttctggcggcgggttacggttcttacgcgaaatacgacaacaacaaccgtacctacaactactgcttctctggtacctcttctgcgaccccggttgtttcttctgcggcgatcctgatccagtctttctaccgtcagaccggtcagtacctgaccccgtctgcgatgaaaaacctgctgatctctaccggtatcccgcagggtggtacccagaaaatcggtccgctgccgaacgttaaaaacgcgatcctgcagctggaatctaaattcgcgaccccggttaaaaaaaccgaaacc

SEQ ID NO: 341 - DNA, 1656 bp, custom Sp.
atgaaaacaaaaattcaaattttctctttgtttatgttctcctgttctctctgtcttgcacagaaaccttcaaacggagactcttatgcaaaagccaatatctatgtctgtttttcaaaaggtattgcttcagcaaaagctgcatttgcacaaaaccctgagctggaaaaattggccagggaaaacagcatgtcatttacctatgaccttggctttactgatgaaaaactttctgagatggcaagaaacagtaagctcaacggttattctcctgaatctgtcgaaaaactgaaaagaatattcaaagctgaccttcccgttcaaaatgaagaatatgcccaaaggctggctcaggctcttgaaagatttcctgaagttgaatatgcatcagtaatgagcagtactcctgtagaacctccgttaatcaatgcttttgttgcaactcctgatctggaaaaccttcagacttacctgaacgacaaccccggaatcaatgccaagtatgcctggtcgagagggattaccggacaaaatataagaatccgtgatgtagaatacggtttttataaaactcacgaaatgcttgccaatcaaaactcaatacaactggaaccaggatattctccaaattccggattatcaaataataattaccgagatcacggtactgctgtagtcagtattttaggttctgtaaaagataatatcggacttacaggagcagtctacaatgcttctgaaatcaaaggatatatggagtggaccactgtaggctacaacagggccgctgcagtgagcagatccatcaatgcatcccaggccggcgatattatcctgtatgaaatgcaaaccggcggtaaagacggtcaatattgccctgcagaatatgacaaagtaatctgggatcttacaaaggcggctacagattcagggataatcattattgcagcagcaggtaatgggaaccagaaccttgatgatcctttctatgcttcttatatgtcaagaggaaacagcggtgctattatcgtgggagctggttcaccaaataccacacattcaaaactaagtttcagcacatacgggaaccgggtggatgtacaaggttggggaagcagtgttctggcggcaggatatggttcctatgccaaatatgataatgataacaacagaacatacaattacttcagtggaacaagctctgcaactcctacggtagcttctgccgcggtgctgattcagtcatattatcgccaaaccacaggtcagtacctgagtccggctgccatgaagaaccttttaatttctacaggaataccccagggtggcactgttgccaatcaaaaaatcgggcctcttcccaatgtaaaaaatgccatactccaattggaaggcaaatcggcaaaggctgttaaagctttaccatcattggaagtaaaaatctatcctaatccgtcccaaaatgttataacccttcaaaatgtggaaaataaaaagcttgattttgaaatcattagtatgcagggacgatctgtcatcaggggaacagcaatgccggaagaaaaaattgatctttcaagcctgttgcccggacaatatattattacgatcagtgaagggcaacgaagagttgttgaaaaactgataaagcaataa

SEQ ID NO: 342 - DNA, 1656 bp, custom Sp.
atgaaaaccaaaatcaaactgttcgcgctgttcatcttctgctcttctctgtctttcggtcagaacccgtctaaccagctgaaccgtgaccagaactctaacatctacgtttgcttctctaaaggtatcaactctgaaaaagcggcgttctctaaaaacccggaactggaaaaattcgcgcgtgaaaacaaaatctctttcacctacgacctgggtttcaccgacgaaaaactggacgaaatggcgcgtaactctaaagcgaacggtaactctggtgaatctgttgaaaaactgaaacgtatcttcaaagcggacctgccgctgcagaacgaagaaaccgcgcagaaactggcgcagaccctggaacgtttcccggaaatcgaatacgtttctgttatgtcttctaccccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctggcgaaccagaactctatccagctggaaccgggttactctccgaactctggtctgtctaacaacaactaccgtgaccacggtaccgcggttgtttctatcctgggttctgttaaagacaacatcggtctgaccggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgtcttacatggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccgaccgttgcgtctgcggcgatcctgatccagtcttactaccgtcagaccaccggtcagtacctgtctccggcggcgatgaaaaacctgctgatctctaccggtatcccgcagggtggtaccgttaccaaccagaaaatcggtccgctgccgaacgttaaaaacgcgatcctgcagctggaatctaaatctgcgacctctaccaaagcgctgccgccgctggaagttaaaatctacccgaacccgtctaccaactacatcgcgatccagtctaacgaaaacaaaaaactggacttcgaaatcatcaacatgcagggtcgttctgttatcaaatcttctgtttcttctgacgaaaaaatcgacatctctaacctgccgaccggtcagtacatcatcaacatcaacgaaggtcagcgtcgtgttgttgaaaaattcaccaaactg

SEQ ID NO: 343 - DNA, 1656 bp, custom Sp.
atgaaaaccaaaatcaaactgttcgcgctgttcatcttctgcttcttcctgtctttcggtcagaacccgtctaaccagctggaccgttctcagaactctaacatctacgtttgcttctctaaaggtatcaactctgaaaaagcggcgttctctaaaaacccggaactggaaaaattcgttaaagaaaacaaaatctctttcacctacgacctgggtttctctgacaaaaaactggacgaaatggcgaaaaactctcgtgcgaacggtaactctggtgaatctgttgaaaaactgaaacgtatcttcaaagcggacgttccggttcagaacggtgaaaccgcgcagaaactggcgcagaccctggaaaaattcccggaaatcgaatacgtttctgttatgtcttctaccccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtatccgtgacgttgaatacggtttctacaaaacccacgaaatgctggcgaaccagaactctatccagctggaaccgggttactctccgaactctggtctgtctaacaacaactaccgtgaccacggtaccgcggttgtttctatcctgggttctgttaaagacaacatcggtctgtctggtgcggcgtactctgcgtctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgactctgttatctgggacctgaccaaagcggcgaccgactctggtatcatcatcatcgcggcggcgggtaacggtaaccagaacctggacgacccgttctacgcgtcttaccgtgcgcgtggtaactctggtgcgatcatcgttggtgcgggttctccgaacaccacccactctaaactgtctttctctacctacggtaaccgtgttgacgttcagggttggggttctaacgttctggcggcgggttacggttcttacgcgaaatacgacaacgacaacaaccgtacctacaactacttctctggtacctcttctgcgaccccggttgttgcgtctgcggcgatcctgatccagtcttactaccgtcagaccaccggtcagtacctgtctccggcggcgatgaaaaacctgctgatctctaccggtatcccgcagggtggtaccgttgttaaccagaaaatcggtccgctgccgaacgttaaaaacgcgatcctgcagctggaatcttctctggcggcgtctaccaaagcgctgccgccgctggaaatcaaaatctacccgaacccggcgaccaactacatcgcgatccagtctaacgaaaacaaaaaactggacttcgaaatcatcaacatgcagggtcgttctgttatcaaatcttctgtttcttctgacgaaaaaatcaacatctctaacctgccgaccggtcagtacatcatcaacatcaacgaaggtcagcgtcgtgttgttgaaaaattcaccaaactg

SEQ ID NO: 344 - DNA, 1656 bp, custom Sp.
atgaaaaccaaaattaaattgttggctttgtttattttttcattttcattgtcatttggtcaaaatccatcagatcgttcaaatcatcaaaattcaaatatttatgtttgcttttcaaaaggtattaattcagaaaaagctgctttttcaaaaaatccagaattggaagaatttgttaaagaaaatggtatttcatttacctatgatttgggtttttcagatgaaaaattggatgaaatggctaaaaattcaaaagctaatggtaattcaggtgaatcagttgaaaaattgaaacgtatttttaaagctgatgttccagttcaaaataatgaaaccgctcaaaaattggctcaaaccttggaacgttttccagaaattgaatatgtttcagttatgtcatcagaaccaattgaaccaccattggttaatacctttgttaccaccccaaatttggaatcattgcaaacctatttgaatgataatccaggtattaatgctaaatatgcttggtcacgtggtattaccggtcaaaatattcgtattcgtgatgttgaatatggtttttataaaacccatgaaatgttggctaatcaaaattcaattcaattggaaccaggttattcaccaaattcaggtttgtcaaataataattatcgtgatcatggtaccgctgttgtttcaattttgggttcagttaaagataatattggtttgtcaggtgctgcttattcagcttcagaaattaaaggttatatggaatggaccaccgttggttataatcgtgcttcagctgtttcacgttcaattaatgcttcacaagctggtgatattattttgtatgaaatgcaaaccggtggtaaagatggtcaatattgcccagctgaatatgattcagttatttgggatttgaccaaagctgctaccgattcaggtattattattattgctgctgctggtaatggtaatcaaaatttggatgatccattttatgcttcatataatgctcgtggtaattcaggtgctattattgttggtgctggttcaccaaataccacccattcaaaattgtcattttcaacctatggtaatcgtgttgatgttcaaggttggggttcaaatgttttggctgctggttatggttcatatcaaaaatatgataatgataataatcgtacctatacctatttttcaggtacctcatcagctaccccagttgttgcttcagctgctaccttgattcaatcatattatcgtcaaaccaccggtcaatatttgtcaccagctgctatgaaaaatttgttgatttcaaccggtattccacaaggtggtaccgttgttaatcaaaaaattggtccattgccaaatgttaaaaatgctattttgcaattggaatcatcattgaccttgtcagctaaaaccttgttgccattggaaattaaaatttatccaaatccatcaacctcatatattgctattcaatcatcagaaaataaaaaattggattttgaaattattaatatgcaaggtcgtaccgttattaaaggttcagtttcaccagatgaaaaaattaatatttcaaatttgccacaaggtcaatatattattaatattaatgatggtcaacgtcgtgttgttgaaaaatttaccaaattgtaa

SEQ ID NO: 345 - DNA, 1656 bp, custom Sp.
atgaaaacaaaaatcaaattccttattctctttgtattctgttttttcctttcatttgcacaatctccatcagatcgcagtgttccgcaaaacgatctgatctatgtatgttttgcaaaaggtatctcttcagaaaaagatgcacttagtaaaaatcctgaactggaaagatttgtgaaggaaaatagaatatcatttacttatgatctaggttttagcaatgaaaagatcaatgaaatgatcgctagcagcagattgaacggaaattccggagagtctgttcaaaaactgaaaaggatattcaaagcggatgttcctgttcaaaatgctgatacttttcaaagacttactcaagctcttgaaaaatttcctgaaatagaatatgtatctgtgatgagcagtactcctgttgaaccacctcttgtcaacatgtttgtagcaacacctgatctcgaaaatcttcaaatgtatctgaatgacaatccgggaatcaatgcaaaatacgcatggtcaagaggaattaccggacaaaacatccgtatccgcgatgtggaatatggtttctacaaaactcacgaaatgctagcgaatcagaactccattcagctagaacctggatattctcctaattcaggattagcgaacaataattaccgggatcacggaacagctgttgtaagtattttagggtctataaaagataatatcggccttactggagctgtttacaatgcttcagaaataaaaggctatatggaatggaccactgttggatataacagagcttcagcggtaagcagatccattaatgcctcacaagccggagatatcattttatatgaaatgcagactggtggaaaagacggccaatattgtcctgctgaatatgacagtgtgatatgggatcttacaaaagcagcgacagattcagggatcatcatcattgcggcagcaggaaatgggaatcaggaccttgatgaacctttctatgcaatgtacagatccagaggaaacagcggcgccatcattgtaggagccggaactcctaatactactcattcaaaacaaagcttcagtacttatggaagcagagtggatgtacaagggtggggaagcagcgttctggctgcaggatatggatcgtatgcaaagtatgacaatgataataacagaacttacaattatttcagcggaaccagttctgcaacgcctacagtagcttctgcagcggtactgattcaggctttttaccgtcagactacaggacagaatttaagtccggctgctatgagaaatcttttggtttctacaggaattccacagggaggaactgatgtgaataaaaaaattggtccacttccaaatgtaagaaatgccattttacaactggaaggtaaatctacagcttccgccaaagccttacctgctttggaagtgaaaatttatcctaatccatccagcggctatatcgctattcaagctagcgaagataaaaaactggacattgaaattatcaatatgtatggaagatcagtgataaaaagtatggttgcttccggtgaaagaattaatatttcaaatcttcctactggtcagtatatcattaatatcaatgaaggaacgagacgggtggtagagaagtttactaaattatag

SEQ ID NO: 346 - DNA, 1659 bp, custom Sp.
atgaaaacaaaaaccacccttttcgcattatttgcgttctgttctacgctttctttcgggcaggacagccagtctaaaatggctgatgatcaaaattcaattatttatgtatgtttttcaaaaggcatcaattcagaaaaaacagctttcagcagaaatgctgatctggaaagattttcaagagaaaaccacatcacatttaagtatgatctggactttacagacagcaaacttgatgaaatggtcagaagcagcaaagccatcggtaattccggagagtctgtggaaaagctgaaaagaatctataaggctgatgttcctcttcagaataaagaagcttcagaaaaaatcattcatgctcttgagagatttcctgaaatagaatatgtttccgtaatgagtgccgaacctatcgaaccacctttggtaaatgcttttgtggcaactcctgatctggaaggcctgcagacctatctgaatgacaatccgggaattaacgccaaatatgcatggtcaagaggaatcaccggacagaatatccgtgtgcgtgatgtagaatatggcttctataaaactcatgagatgctgtctaaccaaaattcaatacaacttgagtccggttattctcctaatgcaggattagccaataataattaccgtgatcatggaactgctgtggtaagtattttaggttcagtaaaagataatacaggacttaccggagctgcttacagtgcttctgaaataaaaggttatatggaatggaccaccgtgggatacaaccgggcttctgcagtgagcagatctattaatgcatctcaggccggagatattattttatatgaaatgcagactggcggaaaagacggtcagtattgtcctgcggaatatgataaagtaatctgggatcttaccaaagccgctactgattctggaattattatcattgcagcagcaggtaatggaaaccagaatctggatgatccgttttatgcagcctatcttgcaagaggaaacagtggtgctattattgtaggagcaggatctcctaatactacccattcgaaattaagcttcagtacttttggaagcagagtggatgttcagggctggggaagcagtgtgatggcggcaggttatggatcttatgcgaaatatgacaatgacaacaacagaacttataattatttcagcggtacaagttctgcaacaccggtagtttcttctgcagctattttaatccagtctttttatcgtcagactacaggtcagtatttaacgccttcggcaatgaaaaaccttttaatttcaacgggaattcctcagggaggaactgtaacaggtcaaaagattggcccacttcctaatgtgaagaatgccattcttaagctggaaagtaaatttgcagcacctgttaaaactttatctgccttagaggttaaaatttatcctaatccgtccagcagttctatcgctcttaaaagcagtgaaaataaaaaactggatgtagagattattaaccttcagggacgaactgttatcaaaaattcagttttgccaaatgagaaaattgacatctcacagctgccagcaggtcagtatattattaacatcaatgaaggccagagaagagttgttgagaaactgacaaaactctaa

SEQ ID NO: 347 - DNA, 1848 bp, custom Sp.
atgaaaaccaaaatcaacctgttcgcggttctgttcgcgttctgctcttctctgtctttcggtcaggactctccgaccaacccgccgggtgaactgctgtctaacgacgttctgctgccgtctatcggtctgaaaaaccagcagccgaaaatggcgaacgaccagaactctatcatctacgtttgcttctctctggaagcggaaaacggtaaaggtatcaactctgaaaaaaccgcgctgggtaactacaccttctctcgtaacgcggacctggaacgtttctctcgtctgaacgcggcgggtaacaaaggtgaaaaccacatctctttcaaatacgacctggacttcaccgactctaaactggacgaaatggcgcgtggtatcaaaccggttttcgacaaaaaaaactctaaagcgatcggtaactctggtgaattctctgttgaaaaactgcgtatctacaaagcggacccgctgcagaacaaagaaaccaccgaaaaaatcatccacaccctggaacgtttcccggaaatcgaatacgtttctgttatgtctgcggaaccgatcctggaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggactacccgccgttctacgcgacctacctggcgcgtggtaactctggtgcgatcatcgttggtgcgggttctccgaacaccacccactctaaactgtctttctctacctacggtaaccgtgttgacctggttcagggttggggttcttctaccgttctggcggcgggttacggttcttacgcgaaatacgacaacgacaacaaccgtacctacaactactgcttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaaaaccgaaaccctgtctgcgctggaagttaaaatctacccgaacccgtcttcttcttctatcgcgatccagtcttctgaaggtgttaacaaaaaactggacatcgaaatcatcaacctgcagggtcgtaccgttatcaaatcttctgttctgccgaacaacgaaaaaatcgacatctctcagctgccgaccggtcagtacatcatcaacatcaacgaaggtcagcgtcgtgttgttgaaaaactgaccaaactggttaaa

SEQ ID NO: 348 - DNA, 1659 bp, custom Sp.
atgaaaacaaaaatcaaccttttcgcattgtttgcgttctgttcttccctgtcttttggtcaggaaagccagcccagactaaatcaggatcaaaattcaatcatctatgtatgcttttcaaaaggcattaattcagaaaaaactgcattcagtagaaatgctgatctggagagattttcaagagaaaataatatttcatttaagtacgatctggattttacagacggtaaacttgatgaaatggccagaagcagcaaagccatcggaaactcatcagaatctgtagaaaaactgaaaagaatctataaggctgatctgcctcttcaaaatgaagaaaccactcagaaaatcattcacagtcttgaaaggttccctgaaatagaatatgtatcggtaatgagtgcggctcctattgaacctcctttggtgaatgcttttgtggcaacacctgatttggaaagcattcagacttatctgaatgacaatccgggaatcaatgcaaaatatgcttggtcaagaggaatcaccggacagaatattcgtgtaagggatgttgaatatggtttttacaaaactcatgaaatgcttaccaaccaaaattcaatacagcttgaaccgggatattctccgaatgcaggattagctaataataactaccgtgaccacggaactgcagtagtgagtattttaggttcaataaaagataacatcgggcttacaggggctgcctacagtacttctgaaataaaaggatatatggaatggaccactgtgggatacaacagagcatccgccgtgagcagatctattaatgcttcccagtcaggcgatattattttatatgaaatgcagaccggaggaaaagacggccagtattgtcccgcagagtatgacaaagttatctgggatcttacgaaagcagctactgattcagggattattatcattgccgctgcaggtaacggaaatcagaatctggatgatccgttctatgcaacttatcttgccagaggaaatagcggtgctatcattgtaggagcaggatctcccaataccacccattcaaaattaagtttcagtacgtatggaaacagagtggatgttcagggttggggaagcagcgttcttgctgcaggttatggttcttatgccaaatacgataatgataacaacaggacttataattattttagcgggacaagttctgcaacacccgtagtatcttctgcagctattttaattcagtctttctatcgtcagactacaggtcagaacctgacaccatctgcgatgaaaaacctcttgatttctacgggaattcctcagggaggaactgtaacggggcagaaaatcgggcctcttcctaatgtaaaaaatgcaatattgcaattggaaagtaaatttgctacccctgtaaaaacattgtctccgctggaggttaaaatctaccctaatccatccagcagtactattgctattcaaagtacagaaaataaaaagcttgattttgaaatcatcaatcttcaggggcgtacagtaatcaaaagttctgttttgtctaatgaaaaaattgatatttcacaactgccaactggtcaatatatcatcaatattaatgaaggccaaagaagagttgttgagaaattcacaaaactataa

SEQ ID NO: 349 - DNA, 1659 bp, custom Sp.
atgaaaacaaaaatcaactttttcgcattgtttgcgttctgctcttccctgtcttttggtcaggacatccagaccaaaatggctaatgatcaaaattcagttatctatgtatgcttttcaaaaggcattaattcagaaaaaacggcattcagcagaaatgctgatctggaaagattttcaagagaaaataaaatttcatttaagtatgatcttgattttacagacaacaaacttgatgaaatggccagaagcagcaaagcaattggaaactcctcagaatctgtcgaaaaactgaagagaatttataaagctgatttgcctcttcaaaatgaagaaaccactcagaaaatcattcacagtcttgaaagatttcctgaaattgaatatgtatctgtgatgagtgctgctcctattgaacctcccttggtaaatgcttttgtagcaacacctgatctggaaagcattcagacttatctgaatgacaatccgggaatcaatgcaaaatatgcctggtcaagaggaatcaccggacagaatatccgtgtaagggatgtggaatatggtttctacaaaactcacgaaatgctttctaatcaaaattctatacagctggaacccggatattccccgaatgcaggattagccaataataactaccgcgaccacggaactgctgtggtgagtattttaggttcaataaaagataatatcgggcttacaggagcggcctacagtacttcagaaataaaaggatatatggaatggactactgtaggatataacagagcttctgctgtgagcagatctataaacgcttctcaggcaggtgatattattctgtatgaaatgcagaccggaggaaaagacggccagtactgtcctgcagaatatgatcaggtgatctgggatcttaccaaagctgctactgattcaggaattatcattattgctgcagcaggtaacggaaatcagaatctggatgatccgttttatgcaacttatcttgcccgtggaaatagtggtgccattattgtaggagcaggatctcctaataccactcattcaaaattaagtttcagtacttatggaaaccgggtggatgttcagggctggggaagcagtgttcttgctgcgggttatgggtcttatgccaaatatgacaatgataacaacaggacttataattatttcagcggtacaagttctgcaacgcctgtagtgtcttctgcagctattttaattcagtctttctatcgtcagactactggtcagaatttaacaccatctgcgatgaaaaatctattgatttctactggaattccacagggaggaactgtaaccggtcagaaaatcggacctcttcctaatgtaaaaaatgcgatactgcaactggaaagtaagtttgctatccctgtaaaaacattatctccgctggaggttaaaatttatcctaatccatccagcagtactattgctattcaaagtgctgaaaacaaaaagctgaattttgagatcatcaaccttcaggggcgtactgtgatcaaaagttctgttttatctaatgaaaaaattgacatttcccaactgccgacaggccaatatatcatcaatatcaatgaaggccaaagaagagttgttgaaaaattcacgaaactataa

SEQ ID NO: 350 - DNA, 1656 bp, custom Sp.
atgaaaaccaaaatcatgctgttcgcgctgttcatcttctgcttcttcctgtctttcggtcagaaccgtaaaggtcagcagctgcagtctaactctcactctctgtacgtttctttctctaaaaacgttaacgcggaagcggacatcatctctaaaaacccggaattcaaaaaattcgttgaagaaaaccgtatctctttcgttaacgacctgggtttctctgacaaaaaactgaacgaaatgaaagaaaactctcgtaaaaaccgtaactctggtgaatctgttgaaaaactgaaacgtatcttcaaagttgaaaccgcggttcagaacaacgaagacatcctgaaactggcggaatctctggaaaaattcccggaaatcgaatacgcgtctctgatgtctaacaccccgatcgaaccgccgtctaccaacgcgttcgttaccaccccgaacctggaatcttctcagacctacctgaacgacaacccgggtatcaacgttaactacgcgtggtctcgtggtatcaccggtcagaacatccgtatccgtgacgttgaatacggtttccacaaaacccacgaaatgctggttaaccgtaacaccatccagctggaaccgggtgttaccccgaactctgcgctgaccaacaacaactacctggaccacggtaccgcggttgtttctatcctgggttctgcgaaagacaacatcggtctgtctggttctgcgtacaacgcgaccgaaatgaaaggtttcctggaatggaccaccaccggttacaaccgtgttgcggcggttacccgttctatcaacgcgtctcaggcgggtgacatcatcctgtacgaaatgcagaccggtggtcagaacggtaactacgttccggcggaatacgacaacgttatctgggacctgaccaaagcggcgaccgactctggtatcatcatcatcgcggcggcgggtaacggtaacgaaaacctggactcttctttctacgcgtcttacaacgcgcgtggtaactctggtgcgatcatcgttggtgcgggttctaacaacaccgcgcactctaaactgtctttctctacctacggttctcgtgttgacgttcagggttggggtcagaacgttctggcggcgggttacggttcttacgcgacctacgacggtgacaccaaccgtacctacacctacttctctggtacctcttctgcgaccccgatcgttgcgtctgcggcgatcctgatccagtcttactaccgtcaggcgaccggtcagtacctgtctccggcggcgatgaaaaacctgctgatcaacaccggtatcccgcagggtggtaacgttgcgacccagaaaatcggtccgctgccgaacatcaaagcggcgatcgaacagctggaaaactctctgaccgcgtctacccgtaccctgaccccgctgaaaatcaaaatctacccgaacccggcgaccaactacatctctatccgttcttctgaaaacaaaaacatcgacttcgaaatcatcaacatggcgggtcagtctgttctgaaatcttctgtttcttctgacgaaaaaatcaacatctctaacctgccgaaaggtacctacatcatcaacgttaccgacggtcagcgtcgtgttgttgaaaaattcatcaaacag

SEQ ID NO: 351 - DNA, 1656 bp, custom Sp.
atgaaaaccaaaatcaacctgttcgcgctgttcgcgttctgctcttctctgtctttcggtcaggactctcagccgaaaatggcgaacgaccagaactctatcatctacgtttgcttctctaaaggtatcaactctgaaaaaaccgcgttctctcgtaacgcggacctggaacgtttctctcgtgaaaaccacatctctttcaaatacgacctggacttcaccgactctaaactggacgaaatggcgcgttcttctaaagcgatcggtaactctggtgaatctgttgaaaaactgaaacgtatctacaaagcggacctgccgctgcagaacaaagaaaccaccgaaaaaatcatccacaccctggaacgtttcccggaaatcgaatacgtttctgttatgtctgcggaaccgatcgaaccgccgctggttaacgcgttcgttgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggacgacccgttctacgcgacctacctggcgcgtggtaactctggtgcgatcatcgttggtgcgggttctccgaacaccacccactctaaactgtctttctctacctacggtaaccgtgttgacgttcagggttggggttcttctgttctggcggcgggttacggttcttacgcgaaatacgacaacgacaacaaccgtacctacaactacttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctggaatctaaattcgcgaccccggttaaaaccctgtctgcgctggaagttaaaatctacccgaacccgtcttcttcttctatcgcgatccagtctaacgaaaacaaaaaactggacatcgaaatcatcaacctgcagggtcgtaccgttatcaaatcttctgttctgccggacgaaaaaatcgacatctctcagctgccgaccggtcagtacatcatcaacatcaacgaaggtcagcgtcgtgttgttgaaaaactgaccaaactg

SEQ ID NO: 352 - DNA, 1659 bp, Chryseobacterium Sp.
atgaaaacaaaaatcaaccttttcgcattgtttgcgttctgtgcttccctgtcttttgggcaggacagccagcacaggatggctaatgatcaaaattcaattatgtatgtatgcttttcaaaaggcattaattcagaaaaaacagcattcagccgaaatgctgatctggaaaagttttcaagagagaatcacatttcgttcaggtatgatcttgattttacggacagtaagcttgatgaaatggccagaaacagtaaagccatcggaaattccacagagtctgtagaaaagctgaaaagaatttataaggctgatcttccacttcagaacacagaaacaacagagaaaattatccgcactctggaaaggtttccagaaatagaatatgtgtctgtcatgagtgctgatcctgttgaacctcctttggtcaatgcttttgtggctacaccggatctggaaagccttcagacttacctgaacgacaatccgggtattaatgcaaaatatgcatggtcaagaggaattaccggacagaatatccgtgtaagggatgtggaatatggtttttacaaaacacatgaaatgctttccaatcaaaacgctatacagcttgagcccggatattctcctaatgcaggattagcgaataataattaccgtgaccacgggactgcagtagtgagtattttaggttcagttaaagataatatcggacttacaggagctgcctacaatacttctgaaataaaaggctatatggaatggaccactgtgggatacaacagagcttctgcagtgagcagatctatcaacgcatctcaggctggcgatattattttatatgaaatgcagaccggtggcaaagatggccagtattgccctgctgagtatgaccaggtcatctgggatcttacaaaagcggctactgattcaggaattattgttattgctgctgcaggtaatggtaaccagaatctcgatgatccgttttatgccaactatcttgcgagaggaaacagtggagctatcatcgtaggtgcgggatctcccaataccacccattcaaaactgagcttcagtacttatggaaacagagtggatgttcagggttggggaagcagtgtactggcagcaggctacggatcttacgcgaaatatgacaatgataataacagaacctataattatttcagtggtacgagttctgctacgccggtggtgtcttctgcagctattctgatccagtctttttatcgccagacaacaggacaatatttaacacctacggcgatgaagaatcttttgatttctacgggaattccgcagggaggaactgtaacgggacagaagataggccctcttcctaatgtgaagaatgccatacttcaactggaaagtaaatttgccacccctgttaaaaccttagctgcattagaagttaaaatttatcctaacccatccagcagcagcattgctattcaaagtaatgaaaataaaaagctggatattgaaatcattaattttcaaggacgtacagtaattaaaagttcagttttacctgatgaaaaaattgatatttcccaactgcctacaggtcagtatatcattaatatcaatgaaggtcagagaagagttgttgagaaattaaccaaaatatag

SEQ ID NO: 353 - DNA, 1653 bp, custom Sp.
atgaaaacaaaaattaatcttttagcattactgctctcctgctctctttctttcggtcagcattcttcagaccggggtactcatcttaattcaaatatttatgtatgcttttcaaaaggtataacctcagagaaagtggcatttgataagaatccggatttggaaaaattcatcactgaaaataaaatttcctttacgtatgatcttggtttcagcgatacgaaattggatgaaatggcaaaaaacagcagaatgaatggtttttccggggagtctgtggaaaaactgaaaaggatttttaaagccgatgttccggttcaaaatggagaaacagctaaaaagctcattcagattcttgaaaggttccctgaaatagaatatgtatcggtaatgagtagtgagcctattgagcctccattggttaatacatttgtaaccactcccaatttagaaagcttgcagacttatctgaccgataatccgggaatcaacgccacctatgcatggtccagaggaattacagggcaaaatatcagaattcgtgatgttgaatatggtttttataaaacacacgaaatgctggctaatcaaaacgctatacaactggagcccggatacagtccgaactccggtttatcaaataataactaccgtgatcacggaacggctgtggtaagcattttaggatctgtaaaagataatatcggactttccggagcggcctacagcgcctctgaaataaagggatatatggaatggactactgtaggctacaacagagcttcggcagtaagcagatcgatcaatgcgtctcaggccggtgatattattttatatgaaatgcagacaggaggaaaagataatcaatattgtcctgcagaatatgatagcgttatctgggatctgacaaaagcagcaactgattctggaattatcattattgcagcagcaggaaatggaaatcaaaaccttgatgatcccttctatgcagcttataatgcaagaggaaacagtggggccattattgtgggggcaggctctcctaatactacccactcgaaactaagtttcagtacctacggaaaccgagtggatgtacagggttggggaagcaatgtgctggcagcaggatatggctcatatcaaaaatatgacaacgacaataacaggacttatacttattttaatggaacaagttccgcaactcctgtagtggcttcggcagcaacactgatccagtcttattactaccagaatacgggccagtacctaagcccttcagctatgaaaaaccttttaataagcacaggaattcctcagggagggacagttgtcaaccaaaaaataggtcctttacctaatgtaaaaaatgctatactgcaattggaaagtaccctgcggggcacaattaaaagccagcttcctttagaaattaaaatttatccaaatccaacaacaagctatatagcagttcaaagcaaagaaaataaaaagcttgattttgaaattatcaatatgaatggacgaactgtgaacaaagggtccattattcctgatgaaaaaatcaatgtttcacaacttccacaaggtcagtatatcatcaattttaatgatggccaacggagagcaatagaaaaattttcaaaattataa

SEQ ID NO: 354 - DNA, 2088 bp, custom Sp.
atggttaccttcttcatcaaaatgaaaaccaaaatcaacctgttcgcggttctgttcgcgttctgctctatctactctctgtctttcggtcaggactctctgccgaccaacccgccgggtgaactgctgtctaacgacgttctgctgggttacccgtctatcggtctgaaaaaccagcagccgaaaatggcgaacgaccagaactctatcatctacgtttgcttctctctggaagcggaaaacggtaaaggtatcaactctgaaaaaaccgcgctgggtaactacaccttctctcgtatcaccgaattcgacctgctgttcgacatcgactctatcatcgaagaagttctgaaagacttcggtaaagacgcggaatacccgttcctgccgccgaaacgtaacgcggacctggaacgtttctctcgtctgaacgcggcgggtaacaaaggtgaaaaccacatctctttcaaatacgacctggacttcaccgactctaaactggacgaaatggcgcgtgaaaaattcgactctctgccggttttcctggcgatcaaaaacaaactgggtatcaaaccggttttcgacaaaaaaaactctaaagcgatcggtaactctggtgaattctctgttgaaaaactgaaacgtatctacaaagcggacctgccgctgcagaacaaagaaaccaccgaaaaaatcatccacaccctggaacgtttcccggaaatcgaatacgtttctgttatgtctgcggaaccgatcctggaaccgccgctggttaacgcgttcccgcagcagctggaaaacatcaaatctgttgacgacgttaccgacgcgaccccggacctggaatctctgcagacctacctgaacgacaacccgggtatcaacgcgaaatacgcgtggtctcgtggtatcaccggtcagaacatccgtgttcgtgacgttgaatacggtttctacaaaacccacgaaatgctgtctaaccagaactctatccagctggaaccgggttactctccgaacgcgggtctggcgaacaacaactaccgtgaccacggtaccgcggttgtttctatcctgggttctatcaaagacaacatcggtctgaccggtgcggcgtactctacctctgaaatcaaaggttacatggaatggaccaccgttggttacaaccgtgcgtctgcggtttctcgttctatcaacgcgtctcaggcgggtgacatcatcctgtacgaaatgcagaccggtggtaaagacggtcagtactgcccggcggaatacgacaaagttatctgggacctgaccaaagcggcgaccgactctggtatcatcatcatcgcggcggcgggtaacggtaaccagaacctggactacgacccgccgttctacgcgacctacctggcgcgtggtaactctggtgcgatcatcgttggtgcgggttctccgaacaccacccactctaaactgtctttctctacctacggtaaccgtgttgacctggttcagggttggggttcttctaccgttctggcggcgggttacggttcttacgcgaaatacgacaacgacaacaaccgtacctacaactactgcttctctggtacctcttctgcgaccccggttgtttcttctgcggcgatcctgatccagtctttctaccgtcagaccaccggtcagtacctgaccccgtctgcgatgaaaaacctgctgatctctaccggtatcccgcagggtggtaccgttaccggtcagaaaatcggtccgctgccgaacgttaaaaacgcgatcctgcagctgcaggaatctaaattcgcgaccccggttaaaaaaaccgaaaccctgtctgcgctggaagttaaaatctacccgaacccgtcttcttcttctatcgcgatccagtcttctgaaggtgttaacaaaaaactggacatcgaaatcatcaacctgcagggtcgtaccgttatcaaatcttctgttctgccgaacaacgaaaaaatcgacatctctcagctgccgaccggtcagtacatcatcaacatcaacgaaggtcagcgtcgtgttgttgaaaaactgaccaaactggttaaa

SEQ ID NO: 355 - DNA, 2175 bp, custom Sp.
atggctcccctttcgtcaaaattgaaaccaacgttctcgaatcgcttggcgctcgccgctaccattgggtctatcgccattatgccggccatacccagttacgcccaaatactcagtacggacaacttacctacattgggattgggtagcgatgcctttcaatttgacccacttccctcctctgatggtactgaacgctttctggctaaatatgggcagaatgcggcaaacttgacctctgaggaaaacaagacaaaaaacctctcggaaatggcacaggactatgctcgtcaaaaagcagctgatgttgccaccgatgaaatatctcactggctgtcaaaagctggtaatgctaggctcaatattaaccttgataaacaactgtcgattaaaaatacccaattggactggttgataccttggtatgaccaacccgatttgttactgttttcccaacacagcattcaccgaactgatggcaggctgcaaactaatcacggtatagggttacgccactttaaccaaaacagcatgatgggtctgaataccttttttgaccatgatttatcctatcatcattcccgcttaggatttggcctagaatacgcacaggattacgccaaaatcagcgctaatagctacttaaggctatcttcttggcgcagcacatcagaattaaaagatgattatgatgcgcgccctgccaatgggtgggatattcaagtcgaagggtggcttcctacttattcaaacttaggcgctaacttaaaactagagcaatattacggtgatgacgtcgctttatttggtaaaaataaacgtcagaaaaaccctatggccaccactgttggtgtgcattggacccctttcccattactgggtattaatgcagagcataaaataggaaatggcaataccaacgaaactcgtgtaaacctcggtttaacctggctattaggcaaaaatctagcgcagcaccttgacgcttcagcagtcgatgcaactcaccgtatttccagtaaccgtcatgattttgttaatcgcaacaataatattattttggaatatcaaaataaaaacttaattttgctgtcattacctcaggttattcaaggcgtgaccggcgaagaagtgtctattattcgcaacttaatctcagagtatcctctcgaaaaaattattgttgaagcccctgagttggtagcggcaggtggtagcattacgctaaatggtctcaagagttcagtgaagttgccctcttacaaaatagcggaaaatgacgttaaaaaccaacaactcaaccgatatcgcctaacagtaaccgcttatgacattaaggggaacatgtcaccacaagctgaaaccttagttgaagtgtccaatactggcttgctcgctatcatccataaaaatggtacaaaaaagagtaatgttatagcaaatggtcgagacccaaatgtattcactgtagttattaaggatgcgcttggacataccgtcccaaatgcaaaagtgaattttaccctacccgctgggcttacctcgttcaatcaaaaaaatacaagttattattcgttatttaaccattttatgtggaaagcacaggtcgcaaaatccgcttcagaacaagagttcgccattatcgctaatagcaaaggagaagcttctattcaatttacagcttcggtatcagggagctacgccttaaaagccagtacgcaatatggtgcagaaattaacgaacagtttaactttaaacccgatattgatcagtcgtttatcggcagtatagagattatgcaaaacaatgcgttggcagatgggaacagtaaaaataaaattaaatttcatattgtgaataatagccgacaaagtatcgcaggtgcacaagtgcattttagtggtaaaaatgtcgctatttcaccgacgatacctaccgatgagcagggaaataccgaattagaaatcagtagcttaactgctggaacaacagaaatcattgccactcttaatggtgatagcagggtcataccggttaactttatagacaaaaatgccacgtatcacagtcaagaaaaccgtatcgtttataagggggccttatttaggcagcccactcataaacctgccccccaaacagactcattgtggcatttattcggtcaattattttaa

SEQ ID NO: 356 - DNA, 2169 bp, custom Sp.
atggctcccctttcgtcaaaattgaaaccaacgttctcgaatcgcttggcgctcgccgctgccattgggtctatcgccattatgccggccatacccagttacgcccaaatactcagtacggacaacttacctacattggggagcgatgcctttcaatttgacccgcttccctcctctgatggtactgaacgctttctggctaaatatgggcagaatgcggcaaacttgacctctgaggaaaacaagacaaaaaacctctcggaaatggcacaggactatgctcatcaaaaagcagctgatgttgccaccgatgaaatatctcactggctgtcaaaagccggtaatgctaggctcaatattaaccttgataaacaactgtcgattaaaaatacccaattggactggttgataccttggtatgaccaacccgatttgttactgttttcccaacacagcattcaccgaactgatggcaggctgcaaactaatcacggtatagggttacgccactttaaccaaaacagcatgatgggtctgaataccttttttgaccatgatttatcctatcatcattcccgcttaggatttggcctagaatacgcacaggattacgccaaaatcagcgctaatagctacttaaggctatcttcttggcgcagcacatcagaattaaaagatgattatgatgcgcgccctgccaatgggtgggatattcaagtcgaagggtggcttcctacttattcaaacttaggcgctaacttaaaactagagcaatattacggtgatgacgtcgctttatttggtaaaaataaacgtcagaaaaaccctatggccaccactgttggtgtgcattggacccctttcccattgctgggtattaatgcagagcataaaataggaaatggcaataccaacgaaactcgtgtaaacctcggtttaacttggctattaggcaaaaatctagcgcagcaccttgacgcttcagcagtcgatgcaactcaccgtatttccagtaaccgtcatgattttgttaatcgcaacaataatattattttggaatatcaaaataaaaacttaattttgctgtcattacctcaggttattcaaggcgtgaccggcgaagaagtgtctattattcgcaacttaatctcagagtatcctctcgaaaaaattattgttgaagcccctgagttggtagcggcaggtggtagcattacgctaaatggtctcaagagttcagtgaagttgccctcttacaaaatagcggaaaatgacgttaaaaaccaacaactcaaccaatatcgcctaacagtaaccgcttatgacattaaggggaacatgtcaccacaagctgaaaccttagttgaagtgtccaatactggcttgctcgctatcatccataaaaatggtacaaaaaagagtaatgttatagcaaatggtcgagacccaaatgtattcactgtagttattaaggattcgcttggacataccgtcccaaatgcaaaagtgaattttaccctacccgctgggcttacctcgttcaatcaaaaaaatacaagttattattcgttatttaaccattttatgtggaaagcacaggtcgcaaaatccgcttcagaacaagagttcgccattatagctaatagcaaaggagaagcttctattcaatttacagcttcggtatcagggagctacgccttaaaagccagtacgcaatatggtgcagaaattaacgaacagtttaactttaaacccgatattgatcagtcgtttatcggcagtatagagattatgcaaaacaatgcgttagcagatgggaacagtaaaaataaaattaaatttcatattgtgaataatagccgacaaagtatcgcaggtgcacaagtgtattttagtggtaaaaatgtcgctatttcaccgacgatacctaccgatgagcagggaaataccgaattagaaatcagtagcttaactgctggaacaacagaaatcattgccactcttaatggtgatagcagggtcataccggttaattttatagacaaaaatgccacgtatcacagtcaagaaaaccgtatcgtttataagggggccttatttaggcagcccactcataaacctgcaacccaaacagactcattgtggcatttattcggtcaattattttaa

SEQ ID NO: 357 - DNA, 3774 bp, unknown
  environmental sample
atgagccgattaaaactaagccaacatcaggattgctcaatcaacggcgacaatgatgagctacatagcaacaacttatatatttcgcgaatatcttatatccataaggtaatgacgctgctaagtttaattttattatcgctatttttgaattcagcacaggccgccattaatagcggattatccggtgacgatcgctatgctggtcgttttcctattggttttgagtttcaattttatgataaaacgtacagccgtttttatgtatcgacaaacggtttaattcaattctctaatcctagtattgattataataatacttgccttcctacagcattaaataacacgctttacgttttttgggatgacttacgcaccaatgtcgaaaatcaacctattggtaagattgaatatcaaactttaggcaaagcacctaatcgacggctcgtcgtccagtggaccaatcaatactatttcggcacaaaccttccaatgggctcctttcaggcaattttatatgaaggaaccaatcaaattaaataccaatatcgcaatctgttagatgaacgcagccatggagcaagtgcaactattggaattcaaggaccttccggtcaatttgctgaatatggatgcaatacggcagatatgttgacgtccggccaagcaataacttttacacctaatgatgatggatccatctatgcgattgatcagcaagcagagtatgatttcaacgacatttccggtttgactctcgattatccggccccattactggcctatactaaccatgctccgggctgggaatggcataaaaataaggatttaaatacctaccagatctcaattcagaatggcgctggccaaacggtgtttgagagtgttgttggcaatgtggatcagtatagttatcaggccggcgatattcacggtgaaacctatcgcgcaaaagtacgaggcagcattaacaatggtgccacttgggaaatgtggtcaggactctcttctactgtaacgatagataaagttgaacctagcgttatactaaatgagttctaccgtttatccgctaaatccgcggtaatttcttatgaagcaaatgatgaccttagtggtattaaatcaattcacgtacagattgccgctgatgcagcatttgagcaaattgtcatggaaaccacgttaccaaccaatcgcgctcaatatgtactcgaaaatttaccagatgccacatctctttatgctcgcatttttgctaaggataaagccggtaaccattcaatttattcaactaccttagagctattaattgccgcaccaactttaattacgccagttaatggcacacaggttgatgaaccttttattaccgtcacaggcatcacttacccgaacgctaatgttcagttattccttaacggagtcaagttagataattcggttcagacagacgacaatggcaacttcacaaccgttatttcacttaacaacgaacaaatctatcgcctaagcgcacgcgtccagacaacaaccgcgaccagtccagctagttatgaagttcaattcagctacaaagaaaccggcgcaaccgtactgtttgcttcaccgcccagcgatgtgattctgaccgcaccaaccgaaattaatgtgatagcttccgataaatccggtattgctcaagtcgaactctatgccgataacactttactggaaacgatgacacaagcgccatacagttttatgtggtcgctaacagaaagcgataacggtcagcatacgcttaaagctattgccaccaacggaaaaggaaaaagttttgaggcgataactaatctaacggtgcaagttttgccgccggctataccactaacaccatatacaggtaaaatcgactcagtcacgccttcaatatcttatggacaacctattattattgaaggtcatgccattgatcgcgaaactactcaggtcatggctaatcggccgctgcatattgtgttaatgaacaacggatttaaacgcacgattgcggtgagcagcgatgataacggattattcagctattccttcattccacaatcaacggataacggaacttatagcgtaacggtcattcatcctaaagagcaagaaactgtggctcaaggtgaatttacaatcaagcgggttaagtttcatctggacggttatcaacttactgccgctcacaatgtggcagcaaagattgaaattaaagcgacttcagattttgatgtcaatgggctttactggaccattcgcgctgaagatcagccggctcagcaattacctcaaggtattcatatcagcagcacaccaaccgatattggtgcaggttcaacagtgccgactaatatcttgtttaaagctgatattagtgcagcagaaaccggacatctatatttagtggcgtttgctaatgagtccgataatattgtccgcggcaaatttcaaattaaatatcggttaactgaagcacaacctgcgctttacactaaaccaagttttattcaaaccgggctgacacagaataatagtcttactgaaaccttaacactggccaacagaggtctgactgctgcacaaaatgttcacttggcactacatgatgagcaaggagcaccggcgccatcttgggtattcttagcaaatgaacctcagattaacacttttaacttgggtgacagccttgcgctgaacattacggctcaaccagatgagacgattagtgatggtatataccgctttaatctctatattcgtgcagataaccaaaatgctttcaatgttccggtgattatttctgtaatacaaaacggtaccggcggaattcgatttgacgtagcggatatttataccgctaccttggatgaacaaggacttccaattttaggtgtggccgatgcaacaatcaaactacaaaacgatgctgtcttaactgaacaatatactttaaaaacagacgctaacggtatcgcgcttgccgaccaattaccgcccggaatatatctttatcgcgtcagtgcgcctaaacataatgatgtcacgggtcgcattcggattcgccctggcgtgataaataatgaacacgtatttcttaactacgagctcattaatattgagtttagtgtaactgaaacaactattgacgatgtttatgacattaatttagacgtcacatttaatgcggatgttcctgctccggtcattattctcgaaccacatgcaatcaacctatatggaatgcatgagggtgaagtgaaaacaggagaattgaccttgactaattacggtttagttagagctgatgatattaaatttaaattaccgcaatcagatgagcgttttcactatgagttttttggagatattcctaatcaacttgaacccaaaaagcgcttggttattccctataaaattacaaaattgacagaaaacaccttacccaatacgcgctcacttttcaggttattaccaaaaactacaagtagtgataacaaaaattgtaccgattataaaaataatgctcaagcaaaatacaattatacctgtgcaaatggtgacactagctccggctcagatagtagtagcttttatgagcgtgcaggtgaagattgttatggagcttggggagaagacgaagaagaagaagaaaatgaccccgagcaaacaccttcgccaatgacaaatggctgttctaaagactgtgaaggttgttgttctcccggtaatcgagcaggtaatacctattag

SEQ ID NO: 358 - DNA, 3849 bp, unknown
  environmental sample
atgagccgactaaaactaagccagtgccagcatcgcgctacaagcggcgcaaacgctggccaatactgcaaaacagctcctgcttccggattgacgacctccggctacagagcattaactattctactgtttcttttatgttcttttttcgtcggccttgtgcacgccgcggcgaacaccggactctccggcgacgatcgctacgccgggcgctttccgatcgggtttgagttccgctattacgacaaaacctataatcgattttacgcgtcgaccaacggacttattcagtttaccaatccgagcgtcgagtataacaatgcctgtctgcccggcgagctaaacaatacgctttacgtattctgggacgatttgcgcactaacgtcgacggtcagccgaccggcaaggttgaatatcaaacgctgggcgaagcgcctaaccgtcgactggtggttcaatggaccaatcaatactatttcggcactaatctgccgatgggcacctttcaggcgattttgtttgaaggcaccaatcagattaaatatcagtaccgcaatctgctcgacgagcgcagccgcggcgcaagcgccaccgtcggcattcaggggcctgaaggacagttcgctcagttcggctgcgatacggtcaatatgctgacatccgggcaggccgtgaccttcacgcccgccgaagacggcttaagctacgcggttgacggtcaggccgaatacgattttatcgatatttccggctttaccgtcgactatccggcgccgttagccgcttacactaatcaggcgcccggctgggagtggaaccgcaatagcgatctgaacgcgtatcagattgacgttcaaaattccgccggagaatcgatccttcaggaaaccgtcggcaacgtcggccaatatatttatcaggccggtgaaattcacggtcaaacctatcgcgctaaagttcgcggcagcatcaacggcggcgcgacctgggaaatgtggtcgggactttcatcgccggttaccgtcgataaagtcaaacccgacgccgctatcagcgagtttaaccgcctgtcggccgactccgcggcgattgtctatcagacaaccgacgatttgagcggcgttaagtcgattcaacttcaggttgcgtccgactccgcgtttgataacgttgtactggaaaccgtcctgccggtaaaccgcgctcagttccagttggaacagctgccggaagccgcggcgctttacgcgcgcatttacgccgtcgatagggccggcaaccgttcggacgactccgcgaccgtagagctgcttatcgcctcgccgacgttaatcacgccggtcaatggcacccgcgtcgacgaaccgtttattacggtcagcggcaccacctaccctagcgccgacgttcagctgttcctcgacggtaacccgttagacgcgtcggttcgggccgacgaaacaggctacttcacaaccgttatcgcgctcgacgctgagcaaacctatcgcctgagcgccaaagcgcaaacgacgcttggaaccagtccgcacagctatgaagtgcaattcagctatcgcgaaatcggcgcaacggtgctgtttgccgcgccgaatgcgaacgccgttctgaccgcgccgacggaaatcaccgtcatcgcctccgacaactccggcatcgccaaagtcgagctttatgacggcctgacgctgctgacaaccctgaccgaagcgccttacagcgttatgtggcggctagccgaaagcgataacggcccgcatacgctgaaagccgtggtcaccaacggcaaaggcaagacctttgaagcgttaaccgacgtgacggtagaaatactgccgccggtcgcgccgccgacgccgtataccggtgaagtcagcgcaatcgcgccggcgatctcttacggccagccgatcgtgattaaaggccgggccgtggaacgcgcaagttcacagccgatggccaacgcgccgctgaatatcgtgttaatcaacaacggctttaagcgcactatcgcagtcagcagcgacgataacggcgtgttcagctattcgtttattccgcaatccattgacgaaggcgtttatcaggtcgccgccgctcaccctaacgaaaccgacgcgaccgcgcagggcgagtttaccgtcagccgaattaaattccacatcggcggctataacctaaccgccgcgcgtcaaattccggcgacgattgacgtcagggcgacgccgaacctgaacgtcgacgggctttactggaccatccgcgccgaagatcagcccgacgggcaactgccgcagggcgttacgattaacggcaagccaatcgacattgccgccgattcaacggtaacgactcaggttcagtttaccgccgacgacagcgcggctgaaaccggtcacctgtatctggtcgctttcgccaatgagtccggcgacgttgtccgcggccgactgcagattaagtatcgtctgactcaggcccgaccgacgctttatacttcgccgaactttatccagaccggactggcgcgggaagagagcctgaccgaaaccgtcacgctggccaaccgcggcctgaccgcggcggagaacgttcgcctggagttagccgacgagtccggcgcgccggcgcctgcgtgggtatttttaaccggtccgtcccaaatcggtacggttaacgtcggcgatacggtgacgattaacgttgtcgcccagccggacgagagcgtcagcgaaggcgtctataacatttatctgaacgcccgcgccgacaatcaaccgtacgtctatgcgctgataactatcgccgtggttcaaaacggcaccggcggcattcgcttcgacgtcgccgatatctacaccgccacgctcgacgccgacggccagccaattcccggcgtcgccggcgctacgattaagttgcagaatgatacggtgttaaccgagcagtacactttaaaaaccgataccgacggcatcgccgtcgccgactcgctaccgccgggcatctacctttatcgggtcagtgcacctaagcatagcgatgtcagcggccgcgtacgggttcgtccgggcgtcataaacaacgaacatattttccttaattacgacgtcattaatatcgaatttagcgtcactgaaacgaccgttaaagacgaatatgaagtccagatagacgcgacctacaacacgcaggttcccgcgcccgtcgtattgttcgagccaatgtccatcagccttaacggtatgcagatcggcgaagtcaaaaccggccagctgaccttaaccaactacggtttagtccgagccgacaacctgaacgtcaccctgccccaaaccgacgacaagtaccgctacgaattcttcggcgacattcctaacgaactggcgccgaaaacccgcatcgtcattccttataaagttactaagttgcgggcgggttcagcagtgcgctctgagtttaaccgaaccccaacgccgttttcaccaatgtcggcacgtagcggagggggcgaagaatgcaccgtttacatctctagttatttcgaatcacacactaatgaatgcgccaacggcgatgaaggcagcggcggcagcggcggttcatacactgagataaccggaccctgcggtgaggtaaaaccaggcggatgggaaggtttacctccgggagacggcggtgagggtaacggtaatggcctttcgcctttaccggacccgatgccattagtaccgagctgcgaccctgactgtactgacggccagtgttgcacaccatccggtagtcgcccgcctaacggacggctggataaagtaggccggggataa

SEQ ID NO: 359 - DNA, 1251 bp, Yersinia Sp.
atgaataacattacagaatataacaatacagagaactttgtcccttataatgtatacgctacttcagcctttgaatttgactgggattcttcagccattcttaagcaagcagtgcttaaaggtatatcattcattccttatgtcggtgattatttatcctctattattggcttcttttggaaagaccaagagagagatatctggcaggaaattttgggccgggtacagcaacttatcgaagagaatgtgcttaaagctattaaaggcattttattgggcgatattgctgaacttaaagggaaggttgcatccgttgtcgcggccttgcaggaccatcctggtacaccggaagccaaaagtttatttatgagcgtatcggtacatttggatagcgtacaacgcaagtttactacttttgatcacaaaactaattaccatatcctgccgatgtattcagcaaccgcgttgatgcaaataatgtactggaccatgggcattgagcgtaaagacgatatcggattgaacagtaatgaagttgggcaacttcaacgaaatattaatctattggttacacatgtcgaggattatattcaagagatttacgatacagaattagagatccaatacaacgactcggcacctaatactgtagccaacaatgttatgtatgtacatggctactgtcgggtgcatggtttggagtataccgagatcattcaaagtattcagaagaatagaagcaatacacagggactgtattcaaaaatactgagctactcgactttctttggttggccaaccagtcaggcgcgaattctcgcattaaaagacgaaataaatatgccggagccatttaagccaaaattaataaatggccgtataaaccaagttaagtcagttaaaggctatatacgacgtatcggaggtgctttacgggtaggtggattagaaatcacctttgagaatggtagtaagtactcgcaaggaactgttactggtgaatttagttcaattgaccttaatgggagtgtcattgaaacaatggaaacttggggtagtggcgcaattgacgaagctaaatttaccttaagcgatggccgtacctttactgtcggtcaacgttattcaacaaattacagaaagtttgcacttgagggacactatatttctggcatttttattgccagcgatcgaagtgaacttgccggccaagctgcaaatatttgtgtttcttatcatcagaaacagtga

SEQ ID NO: 360 - DNA, 1251 bp, Yersinia Sp.
atgaataacattacagaatatagcaatacagcggcatttgttccttacaatgtatatgctacttcagcctttgaatttgactgggactcctcagcaattcttaagcaagcagtgcttaaagggatatcattcattccttatgtcggtgattacttatcctctattattgatttcttttggaaagaccaagagagggatatctggcaggaaattttgggtcgggtacaacaacttattgaagagaatgtacttaaggctattaaaggtattctattgggtgatattgccgaacttaaggggaagattgcctccgtagttgcagctttgcaggatcatcctggtacacctgaagccaaaagtctatttatgagcgtatcggtacatttggacagtgtacaacgcaagtttactacttttgatcacaaaactaactatcatattttgccgatgtattcagcaaccgcgttaatgcaaataatgtactggactatgggcattgagcgtaaagacgatattggactgaacagtaatgaagttgggcaacttcaacgaaatattgatctattggttaaacatgtcgaaggctatatccaagggatttacgatacagaattagagatccaatacaacgactctgcgcctaatactgtggctaacaatgttatgtatgtacatggctactgtcgggtgcatggcttggagtacaccgagatcattcaaaatatccagaaaaatggaagcaatacgaagggactgtatttaaaaacactgagttattcgaccttctttggctggccaaccagtcaggcacgaattcttgcattaaaagacgaaattaatatgccggagccatttaagccaaaattaataaatggccgtataaaccaaatcaagtcagttaaaggttttattcaacgtatcggaggcgctttacgggtaggtggattagaagtgacctttgaaaatggtaataagtatcaacaaggaactgttaccggcgaatctagttcaattgacctcaatgggggtgtcattgagacaatagaaacctggggtaatggtgctattgacgaagccaaatttaccctaagcgacggacgtatcttaactgttggtcagcgctattcaacaaactacagaaagtttgcgctcgaggggaaatatatttctggtatttttattgccagcgatcgaagtgaactagccggtcaagctgcaaatatttgtgtttcttatcaccaaaaacagtga

SEQ ID NO: 361 - DNA, 1251 bp, Yersinia Sp.
atgaataacattacagaatatagcaatacagcagccattgttccttacaatgtatatgctacttcagcctttgaattcgactgggactcctcagcaattcttaagcaagcagtgcttaaaggcatatcattcattccttatgtcggtgattacttatcctctattattggtttcttttggaaagaccaagagagggatatctggcaggaaattttgggacgggtacagcaacttattgaggagaatgtgcttaaagctattaaaggcattctattgggtgatattgccgaacttaaagggaagattgcctccgtagttgcagctttgcaagatcaacctggtacacctgaagccaaaagtctatttatgagcgtatcggtacatttggatagtgtacaacgcaagtttactacttttgatcacaaaactaactatcatattttgccgatgtattcagcaacaactttaatgcaaataatgtactggactatgggcattgagcgtaaagacgatattggactgaacagtaatgaagttgggcaacttcagcgaaatattgatctattggttaaacatgtcgagagttatattcaagagatttacgatacagaattagagatccaatacaacgactctgcaccaaatactgtagctaacaatgttatgtatgtgcatggctactgtcgggtgcatggtttggagtacaccgagatcattcaaaatatccagaaaaatggaagcaatacaaagggactgtatttaaaaacactgagttattcgaccttctttggctggccaaccagtcaggcacgaattcttgcattaaaagacgaaattaatatgccggagccatttaagccaaaattagtaaatggccgtataaaccaaataaagtcagttaaaggttttattcgacgtatcggaggcgctttacgggtaggtgggttagaagttatctttgaaaatggtaataaatatcaacaaggaactgttaccggcgaatctagttcaattgacctcaatgggggtgtcattgagacaatagaaacctggggtaatggtgctattgacgaagccaaatttaccctaagcgacggacgtaccttaactgttggtcaacgctattcaacaaactacagaaagtttgcgctcgatgggcactatatttctggtatttttattgccagcgatcgaagtgaactagtcggtcaagctgcaaatatttgtgtttcttatcaccaaaaacaatga

SEQ ID NO: 362 - DNA, 1251 bp, Yersinia Sp.
atgaataaccttacagagtataacaataccgctagtctgattccttaccatgtttatgctacctcggcctacgagtttgactgggattcttcagctatcctcaagcaagcgataattaaaggtatctctttcattccttacgttggagattatctgtcctcaattatcgatttcttctggaaagatcaagagcgcgatatttggcaggaaattctgagccgggtgcaacagcttattgaggaaaatgtccttaaagcgattcagggtatcttattgggcgatatcgcagagcttaaaggcaagattgcatccgtcatctccgcgctacaggatcatcccgggacgccagaagcgaaaagcttatatatgagtgtctctgtgcatttagacagcgtacagcgcaagttcactacctttgatcacaaaaccaattaccatattctttccatgtattcgacgactgctctgatgcaaatcatgtactggactatgggtatcgagcgtaaagatgagattggattaaacaacaatgaggttgggcaacttcagcgaaacattgatcagctggtaaagcatgttgaagattatatccagggtatttacgatgcagagctagatattcaatacaacgactcttcccccaatacagtggcaaataatgtcatgtacgcccacggttattgcagagtacatggtctggaatatacagagatcattcaaaacgttcaaaaaaatggcagtaacacggaaggtctgtatttaaaaacgctgtgttactccaccttctttggctggccaaccagtcaggctcgaattttagcgttaaaagatgaaattaatatgccggaaccattcaaaccaagcctagtgaatagtcgcataaaccagattaaatcgctaaaaggctatatccagcgaattggcggagctttgcgagtcggcggattcgaaattatctttgcaaacggtaatagataccaacagggtacggttaccggtgaatccagctcaattgagcttaatggaagtctgattaatactctggaaacttgggggaatggagctatcgatgaggctaagtttaccttaagcgatggacgaacctttactgtcggacagcgctattcaactaactaccgaaaattcgcccttgatggtcactatatttctggcatttttgtttccagcgatcgaaaagaactggccggtcaggccgcgaacatttgtgtttcctatcaccaaaaacaataa

SEQ ID NO: 363 - DNA, 1251 bp, Yersinia Sp.
atgaataaaattacagagtatgacaatatcgccagtctgactccttaccctgtctatgctagctcggcttacgagtttgactggaattcttccgctatccttaagcaagcgataattaaaggtatatcctttattccttacgttggagattatctgtcctcaattatcgatttcttctggaaagatcaagaacgcgatatttggcaggaaatgatgggacagctgcaccagcttattgaggaaagtgtccttaaagcgattcagggtatcttattaggcgatatcgccgaacttaaaggcaagattgcatccgtagtttccgcgctacaggatcatcccggtacgccagaagccaaaagcttatatatgagtgtctccgtaaatttagacagcgtacagcgcaagttcactacctttgatcacaaaaccaattaccatattctttccatgtattcgacgactgctctgatgcaaatcatgtactggactatgggtattgagcgtaaagatgaaattggattaaacaacaatgaggttgggcaacttcagcggaacattgatcaactggtaaagcatgtcgaagattatacacagggtatttacgatacagagctagatattcagtacaacgaatcttcacccaatacagtggcaaataatgtcatgtacgcccacggttattgccgggtacatggtatggaatatacagagatcattcaaaacgttcaaaaaaatggcagtaacacgaaaggtctgtatttaaaaacgttgtgttatttcaccttctttggctggccaaccagccaggctcggattttagcgttaaaagatgaaattaatatgcctgagccattcaaacccagtctggttaatggtcgcatcaaccagattaaatcgattaaaggctatatccagcgtattggcggagctttgcgagtaggcgggttcgaaattatctttgcaaacggcaacagataccaacagggtacggttaccggtgaatcccgctcaatagaacttaatggaagcctgattaatacgctcgaaacctggggaaatggagctatcgatgaggttaaatttaccttaagcgatggccgaaccttgagtgtcggtcagcgctattcaactaactatcggaaattcgctctcgagggtcactatatttctggcatttttgtttccagcgatcgaaaagagctggccggtcaggccgcgaatatttgtgtttcttaccaccaaaaacaatag

SEQ ID NO: 364 - DNA, 966 bp, Yersinia Sp.
atggaaacaattaatttatttttattaattattttttctaacattggcttcttttggaaagatcaagagagagatatctggcaggaaattttgggccgggtacagcaacttatcgaagagaatgtgcttaaagctattaaaggcattttattgggcgatattgctgaacttaaagggaagattgcatccgttgtcgcggccttgcaggaccatcctggtacaccggaagccaaaagtttatttatgagcgtatcggtacatttggatagcgtacaacgcaagtttactacttttgatcacaaaaccaattatcatatcctgccgatgtattcagcaacggcgctgatgcaaataatgtactggaccatgggcattgagcgtaaagacgatatcggattgaacagtaatgaagttgggcaacttcaacgaaatattaatctattggttacacatgtcgaggattatattcatgagatttacgatacagaattagagatccaatacaacgactcggcacctaatactgtagccaacaatgttatgtatgtacatggctactgtcgggtgcatggtttggagtataccgagatcattcaaagtattcagaagaatggaagcaatacacaggggctgtattcaacaatactgagctactcgactttctttggttggccaaccagtcaggcgcgaattctcgcattaaaagacgaaataaatatgccggagccatttaagccaaaattaataaatggtcgcataaatcaaattaagtcagttaaaagctatatacgacgtatcggaggtgctttacgggtaggtggattagaaatcacctttgagaatggtagtaagtattcgcaaggaactgttactggtgaatttagttcaattgaccttaatggagtgtcattgaaacaatggaaacttggggtagtggcgcaattgacgaagctaaatttaccttaa

SEQ ID NO: 365 - DNA, 411 bp, Yersinia Sp.
atgagcaaggtaaccatcactattgatagctgttcaaatgaagtcgaagttaaaaatcaaactgaggttgataccgaaagtctagcgttgaccactgcacaagttagagccagggtgccaactgaggtcgcacctaattcaagcaccgaagttctgtatcggagtacaccgattattcctgaaagtcgtcgaaatgtaatgatcactaatgatggtgctgcaaatgtcattacagcccaatactactggtcgcatagtttcacgagtcaatggttcttatatacgtctattgacgtcaatgttggtgattctaagctattagtctcaccctccaactcattgtattacagtaaggttgttctgattaataacacaaaccgtaaagcatatgttactgccgaggaaaaatag

SEQ ID NO: 366 - DNA, 411 bp, Yersinia Sp.
atgagcaaggtaactatcactatcaataccgatacaaatgaagtagacgttaaaaacttaactgaggctgataccgagaatttaactttgaccgcagcacaagccagagctagggtgccaactgaggttgctcctaactcaagtaccgaggtcctttatcgcagcacaccgattattcctgaaagtcgtcgaaatgtaatgatcactaatgatggtgctgcaaatataattacagctcaatattattggtcgcacagctttacgagtcaatggttcttgtatacctctattgacgtaaatgtcggtgattctaagttattagtttcaccatctaattcattatattacagtaaggttgttctaattaacaatacaagccgtaaggcatatgtcaccgctgaggaaaaataa

SEQ ID NO: 367 - DNA, 414 bp, Yersinia Sp.
atgaacaaggtaaccatcacgattaatacagaatcaaatacagttgaagtagaaaacccaactgaaatttataaaactgaaacagcggctctaatctccgcccccttcagagcaagggtcgcagccgaggttgctccaaactccagcactgaggtcttctatcaaagcacgcccattattccagaaagccgcaggaatataattatcactaatgatggcgcagcaaaccttattactgccgagtattattggtcgcatagttttacgagccaatggttcctttatacatccgttgaggtgagtgtcggtgaatctaagttactacagtcgccatcgaactcactatattacagcaaagtggtattggtaaataaaaccagccgaaaagcgtacgttactgcggaggagaaataa

SEQ ID NO: 368 - DNA, 1413 bp, custom Sp.
atgaaaaaagcgaaattcgaaacctcttctggtcgtcgtgttttcatccagcgtgcggcggcgggtgcgtctgttctgtctaccgcgggtctggtttacgcgaacgacgacctgccgatgcaggacgaagttcgtcagtctggtctggcgggtgacatctacgacgttctgcgtgaatctatcctgatcggtgcgttcgcggttccggttatcggtggtttcctgtctttcctgggtgcgtctttcatcccgtcttctggtgaatctccggaacagatgtggaaccgtctgatgcgtgcgcgtatctctgacgcgctgctgcgtctggcgcagcgtgacctggttggtctgtctgaagtttctcgtctgtacaaaatcgcgatcgaatctggtaactctgacgaaatccgtgcgcagtctatcgcggcgaacacccagttcaccgcgatggttccgggtttccaggttcgtggtgaagaagcggcgctgctgccgctgttcgcgatcgcggcgaccctgcacctggcgctgctgcgtgacatggttctgaaaggtcgtgacatcggtctgtctgacggtctggttgcgcgttacacctctgaaatggttgttctgatccgtcgttacaccatctacgttgacacccactactcttctaccatcgacaaagcgcgtcgtgacaacccgcactctaccgttggtctggcgcagaacatgccgctgtctgcgatgctgatcgaaaaaaccaaataccagctgaccgttctggacctgcgtgacacctgggcgaacctggacccgatccgttacccgggtaaatctcgtatcaaactggaccgtgaaatcttcaccccggttatcggttggctgggtcgtaaaaactctcgtccggacgttatcccggtttggcgtcgtccgtcttctccgctgtcttctctggaagtttgggaccgtatgcagtggcgtacccgtttcatcttcggtttcgacgcgatgtacgaagacggttctgttatgtcttctggttctcgtatctctaactctcacaacgttcgtctgggtaaatacatcaaccgtgttaccgcggaagcggcggcgggtgtttaccagatgcgtttccgttctaacgacggtcgttggaccaaagttggtcgtgacgcggacgacgacaccccgatccgtcgtttcgactcttcttactctggtcaccgtctgtcttctatccgtcacgttggtatcggtatgggtgcggcggaaggtgcggttcgtggttgcgttctgggtttccagctgatccacccgtctggtgcgccgatgtctcgtgaagcgctgaactctatggcgccgaaaatcgcgccgcaggttctgaaatggctggaagacgaagcgatcccgaaccacggtctgatctaa

SEQ ID NO: 369 - DNA, 1413 bp, custom Sp.
atgaaaaaagcgaaattcgaaacctcttctggtcgtcgtgttttcatccagcgtgcggcggcgggtgcgtctgttctgtctaccgcgggtctggtttacgcgaacgacgacctgccgatgcaggacgaagttcgtcagtctggtctggcgggtgacatctacgacgttctgcgtgaatctatcctgatcggtgcgttcgcggttccggttatcggtggtttcctgtctttcctgggtgcgtctttcatcccgtcttctggtgaatctccggaacagatgtggaaccgtctgatgcgtgcgcgtatctctgacgcgctgctgcgtctggcgcagcgtgacctggttggtctgtctgaagtttctcgtctgtacaaaatcgcgatcgaatctggtaactctgacgaaatccgtgcgcagtctatcgcggcgaacacccagttcaccgcgatggttccgggtttccaggttcgtggtgaagaagcggcgctgctgccgctgttcgcgatcgcggcgaccctgcacctggcgctgctgcgtgacatggttctgaaaggtcgtgacatcggtctgtctgacggtctggttgcgcgttacacctctgaaatggttgttctgatccgtcgttacaccatctacgttgacacccacgcgtcttctaccatcgacaaagcgcgtcgtgacaacccgcactctaccgttggtctggcgcagaacatgccgctgtctgcgatgctgatcgaaaaaaccaaataccagctgaccgttctggacctgcgtgacacctgggcgaacctggacccgatccgttacccgggtaaatctcgtatcaaactggaccgtgaaatcttcaccccggttatcggttggctgggtcgtaaaaactctcgtccggacgttatcccggtttggcgtcgtccgtctaaagcgatcaccaaactggaagtttgggaccgtatgcagtggcgtacccgtttcatcttcggtttcgacgcgatgtacgaagacggttctgttatgtcttctggttctcgtatctctaactctcacaacgttcgtctgggtaaatacatcaaccgtgttaccgcggaagcggcggcgggtgtttaccagatgcgtttccgttctaacgacggtcgttggaccaaagttggtcgtgacgcggacgacgacaccccgatccgtcgtttcgactcttcttactctggtcaccgtctgtcttctatccgtcacgttggtatcggtatgggtgcggcggaaggtgcggttcgtggttgcgttctgggtttccagctgatccacccgtctggtgcgccgatgtctcgtgaagcgctgaactctatggcgccgaaaatcgcgccgcaggttctgaaatggctggaagacgaagcgatcccgaaccacggtctgatctaa

SEQ ID NO: 370 - DNA, 1413 bp, custom Sp.
atgaaaaaagcgaaattcgaaacctcttctggtcgtcgtgttttcatccagcgtgcggcggcgggtgcgtctgttctgtctaccgcgggtctggtttacgcgaacgacgacctgccgatgcaggacgaagttcgtcagtctggtctggcgggtgacatctacgacgttctgcgtgaatctatcctgatcggtgcgttcgcggttccggttatcggtggtttcctgtctttcctgggtgcgtctttcatcccgtcttctggtgaatctccggaacagatgtggaaccgtctgatgcgtgcgcgtatctctgacgcgctgctgcgtctggcgcagcgtgacctggttggtctgtctgaagtttctcgtctgtacaaaatcgcgatcgaatctggtaactctgacgaaatccgtgcgcagtctatcgcggcgaacacccagttcaccgcgatggttccgggtttccaggttcgtggtgaagaagcggcgctgctgccgctgttcgcgatcgcggcgaccctgcacctggcgctgctgcgtgacatggttctgaaaggtcgtgacatcggtctgtctgacggtctggttgcgcgttacacctctgaaatggttgttctgatccgtcgttacaccatctacgttgacacccactactcttctaccatcgacaaagcgcgtcgtgacaacccgcactctaccgttggtctggcgcagaacatgccgctgtctgcgatgctgatcgaaaaaaccaaaatgaccctgaccgttctggacctgcgtgacacctgggcgaacctggacccgatccgttacccgggtaaatctcgtatctacctggaccgtgaaatcttcaccccggttatcggttggctgggtcgtaaaaactctcgtccggacgttatcccggtttggtctccgccgaccaaagcgatcaccaaactggaagtttgggaccgtatgcagtggcgtacccgtttcatcttcggtttcgacgcgatgtacgaagacggttctgttatgtcttctggttctcgtatctctaactctcacaacgttcgtctgggtaaatacatcaaccgtgttaccgcggaagcggcggcgggtgtttaccagatgcgtttccgttctaacgacggtcgttggaccaaagttggtcgtgacgcggacgacgacaccccgatccgtcgtttcgactcttcttactctggtcaccgtctgtcttctatccgtcacgttggtatcggtatgggtgcggcggaaggtgcggttcgtggttgcgttctgggtttccagctgatccacccgtctggtgcgccgatgtctcgtgaagcgctgaactctatggcgccgaaaatcgcgccgcaggttctgaaatggctggaagacgaagcgatcccgaaccacggtctgatctaa

SEQ ID NO: 371 - DNA, 1368 bp, Curtobacterium Sp.
atgcgtccccacaagcacgtcacactcctgtgtgcctcggccgccgtcgcgatcggcgcggccgccctcgctccgtccgccgcgttcgcgcacggcttcgtcggcgacgactcgggcgaccccacccacacgctgaccgcgcgggtcgcgatgcaggcgaacggcgacatgggcggcgcccagtacgacccgcagagcctcgaggcgccgaagggcttcccggccgccggtcccgcggacgggcacctcgcctccgccggccacaccgagtggtcggtactcgacgaacagggcgaggaccgctggcagaagaacgtcgtcgagcagggcgacgtcaccgtcaactggacgtacaccgcgccgcacaagacctcgcagtggcgctactacatgacgaaggacggctgggacccgaacgacgccctcgaccgcgacgacctcgagctcatcgagaccgtcgagcacgacggctccgaggcgtcgaacaacccgtcgcacgagatcacgatcccgtccgaccgcgagggctaccacgtcatctacgccgtgtgggacgtcgccgacaccgcgaacgcgttctacaacgtgatcgacgtcgacgtgcagcccggcgacggcgagaccccggagcccgtcgaggacaccgaggcgcccggtctcgtgccggacgccgcgggccgggctgtcagctcgaccgaagccgagatcacctggggtgccgcgtccgacgaccgcggggtcgcgcgctaccaggtcgtccgactcggcgcgacggagggcgacttccaggtggtgaaggaggtctccgcgaccggacgctcggcgcgactgaccggcctgcagccgggcgaggtctactccttcggcgtccgcgccgtcgacgcggccggcaacgtcggcctcgcgcacacgatcctgaccgtgcggatgcccgagcaggccgccgccccggccgcgccgaagcacctgcacgacatgggtacgaccgagtccaccgtcgcactgatgtggaccgcgggcgacgacaccgagggcgtgcgctacgaggtgttccgggacggcgacaaggtcggcgagaccggtgcgaccgacttcgtcgacgtcggactccgggcgggctcgcgccacgagtacaccgtccgggccgtgaacctcgacggcatcgcctccgcgatgtcgaacaggcacgtcacgaccacgaagggcgacgccgcgtcggagtacccgacctgggacgcgcacgcggcgtacaccaagggcgaccgcgtcacccacggcggttccgtgtacgaggccgtgcagtcctaccagggccacggtgacccgaactggatcaccgcgccctccctctggaagccggtcagctag

SEQ ID NO: 372 - DNA, 1359 bp, Pseudomonas Sp.
atgtctaaacatatagcgaatcctatcagcaagaacatagttccacgtcacggtcatattttttctcccgcctcccgtgcttactttgcttggcaggcaggtgacttggatgagggggcactcaaccagcgtgaatcgggcaagtttttccccgccgtcgctggagggttgctggacgtgtatgcccctgaagatgtagcgaactcgccgccgccgccggatggaaaaattgccagtgccaatcaggctaccgggctgttcctcgatcaacccggtagccactggcaaaaacatgaggtgcgcggtggcgagatgctggatatttcgtggcactttacagctaaccatgtaacccgccgctggaactacttcatcactaaagaggcttgggacccgagccaggtgctgtcccgtgatcagtttgaagcggagcctttttatactgtccagattaatctgaaaccttactggtctcatggcgatgcgatgaaaccaccttcacccactgttcatcaaatgccactgccaatccgcgaggggtatcacgttttgctggcaatttgggaagttgcagataccgcagcggcgttctatcaggttgtggaccttgattttgtagagcgggagggcggcggtgggcggccaaccacgccaaccggcctaaaagccagtgacataaccgataagcaggttcgtttaacctggaacgcttcaaccggatcttcttctatcgcgtcctatcgcattacccgtgatggctctaccactgttgatgtctatgttccgttgttgagctggactgataacagcgtgttaccggggaccagttatagctattttgtgaccgctattgatgacagaggcaaccagtcactaccgagtacggcgattcaggttagaactcaagctgaaggtggtggtacggcccctccaacggcaccggtcaacctgcactctatgaataccaccgcaaatactgtgtcattgatgtggggagcgtcgacaggtggttatccgttgaaacactataatttctatcgcgatggggtgcaggttgcgacgatccccgcttcgcaaaccagctataccgacagcggcctgactgccgcaacaatgtatcgtttttttgtggccgccgaagatactcaagggcaactgtcggtgcctagcaacgtgctaagtgtcaccacctctaccggcgaagggggcgagacgccggagtggaaattaggtgagtcctacaaggtgggcgataaagtcatctatcagggggttaagtacgcgtgtttccaggcacatatctctaacgcgggttggacgcctgcagagacagtaaatattctttggttgctggtttaa

SEQ ID NO: 373 - DNA, 1368 bp, Pantoea Sp.
atggctaacattatttctaaaccaaagaacagtatttcttcccgccatgggcatattttttctccaaaatcacgtgcttttttcgcctgggaaaaagggcagattgatgatggtatgttaaatcagcgtgaggctggaaaattttttcctgctaaggtgagcggtctggccgatccggttgcaccgacggatgttcacagtgcgcttccaccacgagacggggaaatcgccagtgctaatcagggaaacgcaagatttcttgatcaaccgggttcagactggcctaagcatgatgtgatttccggtcagctattacctgttcgctggtattactctgctgtccacgttacgcgtcgctggaattactttattacccgtaaagactggaacccggatttaccattaagccgtgcgcaatttgatgagaagcctttttttagtgttgaattaaccgaacagcctttctggagccatggtgacgcgttgacgccacctaatccgaccgaacatacggtgatgctgcctgaacgacgtagttatcatgtattactggcggtgtgggaggttgccaataccggaaatgcgttttatcaggttatcgatttaaatttcaccgacagcacgattccgcttcctcctcccgcggcgccagaagccttacgggttaagggcatgacatgcgataccatttcacttgcctggagtgccccgtcggtagcggcagcttattacaatatctatcgtgacggattacttgctgacagcgttaaagcggtagaatttactgattcagggctgaaagaagatacggaatatacttatgaagttaccagcgtggctgtttcgggagcagaatctgctcgcagtcataccttaactgtacgaactcagtcctgcgcggctattgataatccgcctactgcgccaggaaatttgcatagcatgaaggtgacaactaacagcgttagcttgatgtggagcccatcgcagagttcggtagccattaagcgctatatccttcaccgggatggtcatgtcattgcgcatacgcctgcctgtcagttgacgtatgtcgacagtcctcttcaggaagatacgacatatcactattatgtcgttgcacaagatgcaaacggacttttgtccgcccccggtaatcaactcgccgtgacgaccgagcaaacatcgacagcacccgatccggatccatatcgcaagtgggccttacgctctacattcagcgcgggcgaaattgtttcccacaatggacgcttatggcaatgtcttcagacgcacgtagcttattcacccgaatgggcacccggtgcctctgattctgcaacactatggcgccaggtaaaaccataa

SEQ ID NO: 374 - DNA, 1956 bp, Arsenophonus Sp.
atgaatataaaaaaatatgcagaaaatagcaaaatagtacatatcaatcataactttatacaagataatcaaagctccttaattagaacttttgttattgaagaagtaaatgttgaatttatacgattggtatttactttggccaatatgccatctggttcatacatagaaattatcgatcgtaagagacaacatacacgtatctttccactaaaggaaggttctacgctaaatgtaactttttatactaattgcattgatattaaagttattttaccaaaaaattatcactatagtaataatcaaataatggaacttgcttattatgaagcacttccgcttaatctaacacaaattgttgaagatagtaatgatgggcgacaaccctacatgtggtataaaaatacgcctttttttaacccagctcgcgctgtacattttgtcgtatttaatggttatggtggaacttgctcatttataggttcagctaatcacgtattaacaaaccgccatgttgctttaggtcccaatagtcaaattgatccggaagcgataaaatccagtgaaatgtgggttaacaaacataatatcgccaacgacttttcatcacctgaaactgatactattcattttgatgtcgataaaatattgacgcacggagaatcaaatggtgggcttggtgattatgccttatttactattgcggattttgattatcacaatgctcacgttaaaactttatttggtggtttaaaactgcaacaaacattaaataaaaaacgtgaaaacatctatattccgcaatatggtggcgcaaagcctttacaaattagtgcccgacttagggattctatggatccttttgcatcaataaatcctgatgtaccagagggaacattactcattcatggagatatggaagcaggatcctccggctcccccctggttggtcgagaaacacacaatatattaggaattttatggagtcgttttataattttccaacaaggtatttcatcaccatacctgctcgataagcttaaagaatttattgctgatagtaatacccaagtcaaagcacaggataatattgtgtcacacaacattgaagccaccccggtagatgacgctgaaattaaagtgatatttggcgataaagaacaattaattccttttaatactgttctagttgaaaaccatgacggctactctattattgaaatggctggcttagatctaacaaccaaaacaactttggcagtaaaatataaagtattggcaattatgtctaataatcaggcgacacatctcaatgatcctgccttaactggtgaagtaactctgcgatttatcccttatcaacatccacaagatactgttattaaaagctggtttgttgctcgaatagaacgaaatggcgaaattgtaaataattatattgcacgtatattaagctataactacgatattttcgaaataccattcgatgttaaaaaagcagattgcatgccattaatatttgatgccaaacaagctaatactattctacatccatttactgaaaccaatcctaatttatcattttatactctacgccatggacaaggagcagaaaatatcggtgaaattagtgatgattactcaattttaaaaacacaagttatcaatgaaaaaggtgaaaaagagttagttactttccaggcatatcgaattaaatccataacagaaagtgagccctacccttatatctctatgccaagcagaattaatgtgaaatgtaattataacattgaaggaccatcatatttaagagtctgttattacccagaggataatcagaatttaattggtaaaggaacattcaaaggcattattgctctccatgcaagcgatgaaagcggttctgctgagagattatgtaaaaatattctattagatattacgataaatggataa

SEQ ID NO: 375 - DNA, 3786 bp, Yersinia Sp.
atgtttatgccattcagagaatttatttctagccatgtcgggcgtcaccccctcttcaaccgcgctcctgtcgccgtgattaatcccatcacattggcgattattgttgcgttctccacccttgccttaccacaaaccgcacgggcgtcgtgcaacaattcgggggggagtacctatatctgtgaaggtgaaaataacgccgggatcatcctaagtggaacggatatcacggttgagacccagctcggttttggcatcatagagcctggagatatagatcctgcgctctcattaatcggctctggtgccatcagctaccttgataccaacagttctgcgcttgataccgctggtgcctattctttgtctatccagaatgatacgtcgatgattgggcaatcgacatccactaacgttcaggccaacggttcaattggcagtggtatctatattagcagccagagtcgcgacaactcgaccatacaggtagacctctccggcatgttatccagcggcctgaatggcactcctgccctttcaatcgactcattggcagacaatgattcaactatcattctgaacatccatgctatttcaggtattgcgggtatccaaagcgataataattcacggtacggaacggccatcaccaatgttgatattgccaacgatatcaacgtcgaatattcaggagcctcgatccaaaattattccaatagtggcaccagcatccttaatttaaattcaaagagtatcagtacagacttcgacgccttggatattaataatagcaattattcaggggaggtgatgaccgatatcaatatcgatggcgatatcagttcagccaatagtcaagctgccaggatttacaatcataccaatagcggtctttcgagccttagatttcgcgcaaataatgtcacgggtgaatatgctggcctttatatcgataatagcagccagaatggcgctgtaaccgatattatattgacgggtgatcttacggctacttcaggatctgctctgtataccaatacctactcggaggaggggaacgtcgagaccgctatcaagttgaataacgtttattctctgtatgacgcactcaatatttacggctataaccaaactggaaatacactgtttgaccttgatgtctcaggcacggttacttcagaaaatggtaccgggattaaagtgatgggaacgacttttgaaggcaattccactatactcatcaatgtgaataacattacttccagcagtcaatcgcttgatatcaacaattacaattcttcgggttcagctctttctgccattactgcaaccgggcatctcgctgcggaatggggacaaggggtaacgttccaaacctattcctctctgggggatgctaccacgctcatccatgtcaatgacattacttcaatggggaatgggatatatagccttactgaggctagccggggtacagtaaccaccgacgtcaccgtgacgggccagattaacgtcagtgatggggagggtataacccttaatacgcagaccattgacggcaataccctggtcaacattgacgtcaataatatcgccagtgaatacgatgctatccacctctataacaataacaacaccacaggcgtggataatggcacaggcgtagacaacggcacatcgaccattgatctgatcacccggggcgcgctggtttcgcagcagggctacgggattaatcttgaaaccaataccgcagacacctatgtcactgtgggcggcttggtgcacggcggcaacggctccgcaattggcattcatcggcttgataacattcaaacatcagccacgttagagctgcaatctggctatgcccttgaaggggcgacacagtcactggtatttactggcaattacgtggatatcaatgatgccgcgctggatctggcaaacagccatctggtgctgggcggaacaggagatgctgttttcgatctcacgcgtattgataaccgtgaagaggccattctggatggcgacccgaaccggatcaccggtttcggcaccctgaccaaaaccaacagcagcatctggacattaaccggatccaatatggccgacggtgacgccaatgccttcctgtcggccaatatcgccggggggattttggtgctggataacgccacgctgggcctgacacctgacgctggggcactgactggagccacagtaaaccgcctcagtgctgccgatatcgccgctgacccgacgcgggtggctaccgaaaccggtgcattaaccctggctgaaggcggcgcgctgtcctcactcggtgactcggtcctgagcggcaacctcatcagcgccggtgggatcctgctgtcaaacacctataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtgggcggggcgtatgcctacaccttacaggccgacggggaagccgccactgcggggcgcaactggtatctctcttcagaactgatgctaaccgagggggtacgctatcaggtgggcgtgccgctgtatgaacaatatccgcaggtgctggccgccctgaataccctgccgacgctgcaacagcgtgtcggtaaccgttacggggcaccgggcgcgctggcagacctgaactttgacgataatcaatgggcctggggccgtattgaagggagccaccaggtcaccgacccggcccgatccaccagcggttcacaacgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcacaggttacggtcttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacgcactgggtaacgggttgtcactgaccccgcagatgcaggtgacctactcgcgggtcgatttcgataccttccgcgatccgtttgatagcgaagtctcgctgcaagagggtgacagcctgcggggccgcattggtgtctcactggataaggaaacgacctggagcgcgaaagacggcaccacccgccgctcacacatttacagtcatctcgatctgcacaatgagttccttaacggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgggtgagctggtaa

SEQ ID NO: 376 - DNA, 3771 bp, Yersinia Sp.
atgtttatgccattcagagaatttatttctagccatgtcgggcgtcaccccctcttcaaccgcgctcctgtcgccgtgattaatcccatcacattggcgattattgttgcgttctccacccttgccttaccacaaaccgcacgggcgtcgtgcaacaattcgggggggagtacctatatctgtgaaggtgaaaataacgccgggatcatcctaagtggaacggatatcacggttgagacccagctcggttttggcatcatagagcctggagatatagatcctgcgctctcattaatcggctctggtgccatcagctaccttgataccaacagttctgcgcttgataccgctggtgcctattctttgtctatccagaatgatacgtcgatgattgggcaatcgacatccactaacgttcaggccaacggttcaattggcagtggtatctatattagcagccagagtcgcgacaactcgaccatacaggtagacctctccggcatgttatccagcggcctgaatggcactcctgccctttcaatcgactcattggcagacaatgattcaactatcattctgaacatccatgctatttcaggtattgcgggtatccaaagcgataataattcacggtacggaacggccatcaccaatgttgatattgccaacgatatcaacgtcgaatattcaggagcctcgatccaaaattattccaatagtggcaccagcatccttaatttaaattcaaagagtatcagtacagacttcgacgccttggatattaataatagcaattattcaggggaggtgatgaccgatatcaatatcgatggcgatatcagttcagccaatagtcaagctgccaggatttacaatcataccaatagcggtctttcgagccttagatttcgcgcaaataatgtcacgggtgaatatgctggcctttatatcgataatagcagccagaatggcgctgtaaccgatattatattgacgggtgatcttacggctacttcaggatctgctctgtatgccaatacctactcggaggaggggaacgtcgagaccgctatcaagttgaataacgtttattctctgtatgacgcactcaatatttacggctataaccaaactggaaatacactgtttgaccttgatgtctcaggcacggttacttcagaaaatggtaccgggattaaagtgatgggaacgacttttgaaggcaattccactatactcatcaatgtgaataacattacttccagcagtcaatcgcttgatatcaacaattacaattcttcgggttcagctctttctgccattactgcaaccgggcatctcgctgcggaatggggacaaggggtaacgttccaaacctattcctctctgggggatgctaccacgctcatccatgtcaatgacattacttcaatggggaatgggatatatagccttactgaggctagccggggtacagtaaccaccgacgtcaccgtgacgggccagattaacgtcagtgatggggagggtataacccttaatacgcagaccattgacggcaataccctggtcaacattgacgtcaataatatcgccagtgaatacgatgctatccacctctataacaataacaacaccacaggcgtggataatggcacaggcgtagacaacggcacatcgaccattgatctgatcacccggggcgcgctggtttcgcagcagggctacgggattaatcttgaaaccaataccgcagacacctatgtcactgtgggcggcttggtgcacggcggcaacggctccgcaattggcattcatcggcttgataacattcaaacatcagccacgttagagctgcaatctggctatgcccttgaaggggcgacacagtcactggtatttactggcaattacgtggatatcaatgatgccgcgctggatctggcaaacagccatctggtgctgggcggaacaggagatgctgttttcgatctcacgcgtattgataaccgtgaagaggccattctggatggcgacccgaaccggatcaccggtttcggcaccctgaccaaaaccaacagcagcatctggacattaaccggatccaatatggccgacggtgacgccaatgccttcctgtcggccaatatcgccggggggattttggtgctggataacgccacgttgggcctgacgcctgccaccaccatattaaatcgcctcagtgccgccgatatcgccgctgacccgacgctagtggctaccgaaaccggtgcattaaccctggctgaaggcggcgcgctgtcctcgctcggtgactcggtcctgagcggcaacctcatcagcgccggtgggatcctgctgtcaaacacctataccggcggcaatggtgccgctaccgacgatcggctgaccgtgaccgggacttatttgggtgaaaataacggttccggtgaaggtgcctggctggccctcgatacggtgctgggggatgacgattctgccaccgaccggttagtgatcaacggcgatgccaccggcaccacctcggttcgggtgaacaatgcgggcggtctgggcgataaaaccctcaatggcatcaatctgatcaccgtggacggtctggcacaggatgacaccttcctgctggccggggactatgtcaccacggatggctatcaggcggtggtggccggggcgtatgcctacaccttacaggccgacggggaagccgccactgcggggcgcaactggtatctctcttcagaactgatgctaaccgagggggtacgctatcaggtgggcgtgccgctgtatgaacaatatccgcaggtgctggccgccctgaacaccctgccgacgctgcaacagcgtgtcggtaaccgttacggggcaccgggcgcactggcagacctgaattttgacgataatcaatgggcctggggccgtattgaagggagccaccaggtcaccgacccggcccgatccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggccttggcaccagcctgacctggtatggcaataacggcgtgtatgtggatggccagttgcagacgatgtggtttgacagcgacctgagctcccgtaccgcagggcatgcggtggccagcggtaacaatggtcgcgggtatacctcagcgatagaagccggtaaaggttacgcactgggtaacgggttatcgctgaccccgcagatgcaggtgacctactcgcgggtcgatttcgataccttccgcgatccgtttgatagcgaagtctcgctgcaagagggtgacagcctgcggggccgcctcggtgtctcactggataaggaaacgacctggagtgcgaaagacggcaccacccgccgctcacacatttacagtcatctcgatctgcacaatgagttcctcaatggcagcaaagtacaggtctcaggggtggagttcgccacccgggatgagcgtcagtcggtggggttaggcgcgggcggtacgtatgaatggcagaatggtcgctacgcggtttacggcaatgtcaatctgctgggggctacgcggaatgtcagtgacaattatgccgtcggcggcacgataggcgcacgggtgagctggtaa

SEQ ID NO: 377 - DNA, 3771 bp, Yersinia Sp.
atgtttatgccattcagagaatttatttctagccatgtcgggcgtcaccccctcttcaaccgcgctcctgtcgccgtgattaatcccatcacattggcgattattgttgcgttctccacccttgccttaccacaaaccgcacgggcgtcgtgcaacaattcgggggggagtacctatatctgtgaaggtgaaaataacgccgggatcatcctaagtggaacggatatcacggttgagacccagctcggttttggcatcatagagcctggagatatagatcctgcgctctcattaatcggctctggtgccatcagctaccttgataccaacagttctgcgcttgataccgctggtgcctattctttgtttatccagaatgatacgtcgatgattgggcaatcgacatccactaacgttcaggccaacggttcaattggcagtggcgtttacattaacaaccagagcagtgacgattcgaccatacgggtagacctctccggcatgttatccagcggcctaaatggcactcctgcccttgcaatctactcattggcagacaatgattcaactatcactctgaacatccatgctatttcaggtattgcgggtatccaaagcgataataattcactgtacggaacggccatcaccaatgttgatattgccaacgatatcaacgtcgaatattcaggagcctcgatccggaattattccaatagtggcaccagtatccttaatttcaattcaaagagtatcaggacagacctcgacgccttggatattaataatagcagttattcaggggaggtgatgaccgatatcaatatcgatggcgatatcagctcagccaatagtcaagctgccaggatttacaattataccaatggcggtctttcgagccttagatttcgcgccaataatgtcacgggtgaatatgctggcctttatatcgataatagcagccagaatggcgctgtaaccgatattatattgacgggtgatcttacggctacttcaggatctgctctgcacgccaataccttctcggaggaggggaacatcgagaccgctatcaagttgaataacgtttattctctgtataacgcactcaatattaacggccataaccaaactggaaatatactgcttgatcttgatgtctcaggcacgattacttcagaaaacggtaccgggattaaagtgatgggaacgacttttgaaggcaattccactatactcatcaatgtgaataacattacttccagcagtcaatcgcttgatatcaacaattacagttcttcgggttcagctctttctgccattactgcaaccgggcatctcgctacggaatggggacaaggggtaacgttccaaacctattcctctctgggggatgctaccacgctcatccacgtcaatgacattacttcaatggggaatgggatatatagccttactgaggctagccggggtacagcaaccaccgacgtcaccgtgacgggccagattaacgtcagtgatggggagggtattacccttaatatgcagaccattgacggcaataccttggtcaacattgacgtcaataatatcgccagtgaatacgatgctatccacctctataacaataactacaccacaggcgtggatgatggcacaggcgtagacaacggcacctcgaccattgatttgatcacccggggtgcgctggtttcacagcagggctacgggattaatatcgaaaccaataccgcagacacctatgtcaccgtgggcggtttggtgcacggcggcaacggcaccgcaattggtcttcatcggctcgaaaatgttcaaacatcagccacgttagagctgcaatctggctatgcccttgaaggcgttacacaggcactggtcttcactggcaattacgcggatatcaatgatgccgcgttggatctggcaaacagccatctggtgctgggcggaacaggagacgccgctttcgatctcggccgtattgataaccgtgaagaggccattctggatggtgacccgaaccggatcaccggcttcggtaccctgaccaaaaccaacaacagcatctggacgttaaccggatccaatatggccgacggtgacgccaatgccttcctgtcggccaatatcggtggggggattttggtgctggataacgccacgctgggcctgacgcctgccaccaccatattaaatcgcctcagtgccgccgatatcgccgctgacccgacgttggtggctaccgaaaccggtgcattaaccctgggtgaaggcggcgcgctgtcctcgctcggtgactcggtcctgagcggtaacctcatcagcgctggcgggatcctgctgtcaaacacctataccggcggcaatggtgccgctaccgatgatcggctgaccgtgaccgggacttatttgggtgaaaataacggttccggtgaaggggcctggctggcactcgatacggtgctgggggatgacgattctgccaccgaccgattagtgatcaacggcgatgccaccggcaccacctcagttcgggtgaacaatgccggcggtctgggcgataaaaccctcaatggcatcaacctgatcaccgtggacggtctggcgcaggatgacaccttcctgctggccggggattatgtcaccacggatggctatcaggcggtggtgggcggggcgtatgcctacaccttacaggccgacggggaagccgccactgcggggcgcaactggtatctctcgtcagaactgatgttaaccgaggggatacgctatcaggcgggtgtaccgctgtatgaacaatatccgcaggtgctggccgccctgaataccctgccgacgctgcaacagcgtgtcggtaaccgttacggggcaccgggtgcgctggcagacctgaactttgacgataatcaatgggcctggggccgtattgaagggagccaccaggtcaccgacccggcccgatccaccagcggttcacagcgtgagattgatgtgtggaagttgcagaccggcattgatgtgccgttgtatcagagccaggacggttcactgctgaccggcggtgtgaacttcacctacggaaaagccaaagcggatatccactcattctttggtgatggccgcatcaacagcgcgggttacggtcttggcaccagcctgacctggtatggcaataacggcgtgtatgtggatggtcagttgcagacgatgtggtttgacagcgacctgagctcccgtaccgcagggcatgcggtggccagcggtaacaatggtcgcgggtatacctcggcgatagaagccggtaaaggttacgcactgggtaacgggttatcactgaccccgcagatgcaggtgacctactcgcgggtcgatttcgataccttccgcgatccgtttgatagcgaagtctcgctgcaagagggtgacagcctgcggggccgcctcggtgtctcactgaataaggaaacgacctggagtgcgaaagacggcaccacccgccgctcacacatttacagtcatctcgatctgcacaatgagttccttaacggcagtaaagtgcaggtctcgggggtggagttcgccacccgggataagcgtcagtcggtgggtttaggcgcgggtggcacgtatgaatggcagaatggtcgctacgcggtttacggcaatgtcaatctgctgggggctacacggaatgtcagtgacaattatgccgtcggcggcacgataggcgcacgggtgagttggtaa

SEQ ID NO: 378 - DNA, 3801 bp, Yersinia Sp.
atgcatatacaattcagagagcctatttctacctcacccgcgcaaccggatgcagggcatcaacacctcttcagccgtgttccagcagccgcgattaatcccattacattggcgattattgttgcgttctccacccttaccttgccacaaaccgcacgggcgacgtgcagtagctccggggtgggaacctatgtttgcgaaggtgaaaataacgcggggatatccctgaacggaacggatatcgtggttgagaccctgcccggttttggcatcacagagcctggagatatagatcctgcgctctcattaatcggctctggtgccatcagttacctcgacaccaacagttctgcgcttgataccgctggtgcctattctttgtctatccagaatgatacgtcgatgattgggcaatcgacatccactaacgttcaggccaacggttcaattggcagtggcgtttacattgacaaccagagcagtgacgattcgaccatacgggtagacctctccggcatgttatccagcggcctgaatggcactcctgcccttgcaatctactcattggcagacaatgattcaactatcactctgaacatccatgctatttcaggtattgcgggtatccaaagcgataataattcacggtacggaacggccatcaccaatgttgatattgccaacgatatcaacgtcgaatattcaggagcctcgatccagaattattccaatagtggcaccagtatccttaatttcaattcaaagagtatcaggacagacctcgacgccttggatattaataatagcaattattcaggggaggtgatgaccgatatcaatatcgatggcgatatcagctcagccaatagtcaagctgtcaaaatttacaattataccaatagcggccttgtgagccttagatttcgcgcaaataatgtcacgggtgaatatgcgggcctttatatcgataatggcagctcgaatggggctgtaaccgatattatattgacgggtgatcttacggctacttcaggatctgctctgtatgccaatacctactcggatgaggggaacgtcgagaccgctatcaagttgaataacgtttattctctgtatgacgcactcaatattaacggctataaccaaattggaaatatgctgcttgacctcgatgtctcaggcacgattacttcagaaaacggtaccgggattaaagtgatgggaatgacttttgaaggcaattccactatgctcatcaatgtgaataacattacttccagcagtcaatcgcttgatatcaacaattacaattcttcgggttcagctctttctgccattactgcaaccgggcatctcgttgcggaatggggacaaggagtaacgttccaaacctattcctctcagggggatgccaccacgctcatccacttcaatgacattacttcaatggggaatgggatatatagctttactgaggctagccggggtacagcaaccaccgatatcaccgtgacgggccagattaactccagtaacggggagggtattacccttaatacgcagagcattgacggcaataccctggtcaacattgacgtcaataatatcgccagtgaatacgatgctatccaattctataacaataactacatcacaggcgtggatgatggcaccggcgtagacaacggcacatcgaccattgatctgatcacccggggcgcactggtttcgcagcagggctacgggattaatatcgacaccaatatcgcagacacctatgtcaccgtgggcggcctggtgcacggcggcggcggcaccgcaattggcatccatcggcttgataacattcaaaaatcagccacgttagagctgcaatctggctatgcccttgaaggggccacgcaggcactggtcttcaatggtaattacgtggatatgaatgatgccgcgttggatctggccaacagccatctggtgctgggtggaacaggagccgccgcgttcgatctcggccgtattgataaccgtgaagaggctattctggatggcgacccgaaccggatcaccggcttcggcaccctgagcaaaaccaacaacagcatctggacgctaaccggctccaatatggctgatggtgacgccaatgccttcctgtctgccaatatcgccggggggattttggtgctggataacgccacgctgggcctgacgccggtcaccggggcactcacgagcgccgcattaaaccgcctcagtgccgctgatatcgccgccgacccgacgctggtggccactgaaaccggtgcattaaccctgggcgaaggtggcgcgctgtcctcgcttggtgactctgttctgagcggtaaccttattagtgccggcgggatcctgctgtcaaacagctataccggcggcaatggagccgctacggatgatcggttgaccgtgaccgggacttattttggtgaaagtaacggttccggcgaaggtgcctggctggcacttgatacggtgctgggcgatgacgattctgccaccgaccggttagtgatcaacggcgatgccaccggcaccacctcggttcgggtgaacaatgcgggcggcctgggcgataaaaccctcaatggcatcaacctgatcaccgtggacggtctggcgcaggatgacaccttcctgctggccggggactatgtcaccacggatggctatcaggcggtggtgggcggggcgtatgcctacaccttgcaggccgacggggaagccaccacggcgggccgcaactggtatctctcttcagaactgatgctaaccgagggcgttcgctatcaggcgggcgtgccgttgtatgaacaatatccgcaggtgctggccgccctgaataccctgccgacgctgcaacagcgtgtcggtaaccgttacggggcaccgggcgcgctggcagcactaaattttgacgataatcaatgggcctggggccgtatcgaagggagccgtcaggtcactgacccggcccgctccaccagcggtgcacagcgtgagattgatgtgtggaagttgcagaccggcattgatgtgccgttgtatcagagccagggcggttcactgctgaccggcggggtgaacttctcctacggtaaagccaaagcagatatcaacgcgttctttggtgatggcagcattaatagctcgggttacggtcttggcaccagcctgacctggtatggcaataacggcgtgtatgtggatggccagttacagaccatgtggtttgacagtgatttaagctccagcaccgcggggcatgccttgatcagcgggaataatggccgtgggtatacctcggcggtagaaacgggtaaacgttatgctctgggtaacggggtgtcgctgaccccgcagatgcaggtgagctattcacgggtggatttcgataccttccgcgatacgtttgatagcgaagtttcactgcaagagggtgatagcctgcgggggcgtatcggtgtttccctggataaggaaacggcctggagcgcgaaagacggcagcacccgccgctcacacatttacagccatctcgatctgcacaatgagttcctcaacggcagtaaagtgcaggtttcgggtattgagttcgctacccgggatgagcgccagtcagtaggtttaggcgcgggcggcacgtatgaatggcagaatgggcgctatgcaatttacggcaatgtcaatctgctgggcgctacgcggaatgtcagtgacaactatacggttggcggcacaataggcgcacgggttagctggtaa

SEQ ID NO: 379 - DNA, 3804 bp, Yersinia Sp.
atgcatatacaattcagagagcctatttctacctcacccgctcaaccggatgcagggcgtcaacacctcttcagccgtgttcctgcagccgtgatgaatccgattacattggcaattattgttgcgttctccaccctcgtcttaccacaaaccgcatgggcggcgtgcaatagctcgggggtgggaacctatgtttgcgaaggtgaaaataacaccgcgatatccctgttcggcacggatatcgccgttgagacccggccaggttttggcataacagaacatgaaattacggattctgcgctctcgttaaccggttcgggtaccatcagttacctcgataccaacagttctgcactggataccgacagtcgatattctttgtatattaagaatgacacattaataaccgagcaatcggcatccattaatgttcagagcaacggctccattagcagtggcgtttacattgacaaccagagcagtgacgattcgaccatacgggtagatctctctggcatcttatccagcagcctgagcggcgctccagccctttcaatcttttcatcggcaggcaatgattcaactatcattctgaacacccacgctatttcaggtgttactggcatccaaagcgataataattcacaaaatggagcgaccatcacccacgttgatgttactggtgatattaacgtcgaaaattcaggcgtctcgatccgaaatgctgccaatggtggcaccagcataattaacttcaattcaaagagtattaatacagaatataacagtttttatattcaaaataccaattatgtaggtggagtgataactgatatcaatattgatggcgatatcagttcagctaatagtcaagcagccaggatttacaattataccaatggcggtcttgcgagccttagatttcgcgcaaataatgtcactggatcgactggcctttatatcgataatagcagccaaaatggcgctgtaaccgatattatattgacgggtgatcttacggctacttcaggatctgctctacaagccaatgcctactcggatgagggaaacatcgagaccgctatcaagttgaataacgtttattctttgtatgatgcactcaatattagcgactatacccgatccggaaatatactgcatgaccttgatatttcaggaacgattactgcagaaaacggtaccggaattaaagtgatgggcgcggctggtgaaggcagttctactatgctcatcaatgtgaataatattacttccagcagtcaatcgcttgatatcaacaattacaattttttgggttcagctttttctgccattaccgcgaccgggcatctcacggcggaatggggacaaggggcaatgctccagacccattcctctctgggggatgccaccacgctcatccacttcaatgacatcactgcaatgagcagtggaatatctctcattaacgaagctaaccaaggtacttcaaccgccgatatcaccgtgacgggccagattaacgtcagccacggagaggggattacccttaatgcactgaccactgatggccgcactttggtcaacgttgacgtcaataatattgccagtgaatacgatgccatacgcctctataactataatgataactacgccacaggcgtggatgatggcacaggcgcagacaacggcacctcgaccattgatctgatcacccggggcgcgctggtttcgcagcagggctacggaattaatattgaaaccaataccgcagacacctatgtcaccgtgggcggcttggtgcacggcggcaatggcaccgcaatcggcattcatcggcttgataacattcaaacatcggccacgttagagctgcaatctggctatgcccttgaaggggttacacaggcactggtcttcactggcagttatgcggagatcaatgatgccgcgctggatctggcaaacagccatctggtgctgggcggagcaggagacgccgctttcgatctcacgcgtattgataaccgtgaagaggccattctggatggcgacccgaaccggatcaccggcttcggtaccctgaccaaaaccaacaacagcatctggacgttaaccggcgccaatatggccgacggtgacgccaatgccttcctgtcggccaatatcgccggggggattttggtgctggataacgccacgctgggcctgacacctgacgctggggcactcactggagccacagtaaaccgcctcagtgctgccgatatcgccgctgacccgacgcgggtggctaccgaaaccggtgcattaaccctggctgaaggcggcgcgctgtcctcgctcggtgactcggttctgagcggcaacctcatcagcgctggcgggatcctgctgtcaaaccactataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtggccggggcgtatgcctacaccttacaggccgacggggaagccgctaccgcaggccgcaactggtatctctcgtcagaactgatgctaaccgagggcgtgcgctatcaggtgggcgtgccgctgtatgaacaatatccgcaggtgctggccgccctgaacaccctgccgacgctgcaacagcgtgtcggtaaccgttacggggcaccgggcgcactggcagacctgaattttgacgataatcaatgggcctggggccgtattgaagggagccaccaggtcaccgacccggcccgatccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggccttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacacactgagtcacggcttgtcgctgactccgcagatgcaggtgacctactcgcgggtcgatttcgataccttccgcgatccgtttgatagcgaagtctcgctgcaagagggtgacagcctgcggggccgcctcggtgtctcactgaataaggaaacgacctggagtgcgaaagacggcaccacccgccgctcacacatttacagtcatctcgatctgcacaatgagttcctcaatggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgggtgagctggtaa

SEQ ID NO: 380 - DNA, 3795 bp, Yersinia Sp.
atgcatatacaattcagagagcctatttctacctcacccgctcaaccggatgcagggcgtcaacacctcttcagccgtgttcctgcagccgtgatgaatccgattacattggcaattattgttgcgttctccaccctcgtcttaccacaaaccgcatgggcggcgtgcaatagctcgggggtgggaacctatgtttgcgaaggtgaaaataacaccgcgatatccctgttcggcacggatatcgccgttgagacccggcccggttttggcataacagaacatgaaattacggattctgcgctctcgttaaccggttcgggtactatcagttacctcgataccaacagttctgcactggataccgacagtcgatattctttgtatattaagaatgacacattaataaccgagcaatcggcatccattaatgttcagagcaacggctccattagcagtggcgtttacattgacaaccagagcagtgacgattcgaccatacgggtagatctctctggcatcttatccagcagcctgagcggcgctccagccctttcaatcttttcatcggcaggcaatgattcaactatcattctgaacacccacgctatttcaggtgttactggcatccaaagcgataataattcacaaaatggagcgaccatcacccacgttgatgttactggtgatattaacgtcgaaaattcaggcgtctcgatccgaaatgctgccaatggtggcaccagcataattaacttcaattcaaagagtattaatacagaatatgacagtttttatattcaaaataccaattatgtaggtggagtgataactgatatcaatattgatggcgatatcagttcagctaatagtcaagcagccaggatttacaattataccaatggcggtcttgcgagccttagatttcgcgcaaataatgtcactggatcgactggcctttatatcgataatagcagccaaaatggcgctgtaaccgatattatattgacgggtgatcttacggctacttcaggatctgctctacaagccaatgcctactcggatgagggaaacatcgagaccgctatcaagttgaataacgtttattctttgtatgatgcactcaatattagcgactatacccgatccggaaatatactgcatgaccttgatatttcaggaacgattactgcagaaaacggtaccggaattaaagtgatgggcgcggctggtgaaggcagttctactatgctcatcaatgtgaataatattacttccagcagtcaatcgcttgatatcaacaattacaattttttgggttcagctttttctgccattaccgcgaccgggcatctcacagcggaatggggacaaggggcaatgctccagacccattcctctctgggggatgccaccacgctcatccacttcaatgacatcactgcaatgagcagtggaatatctctcattaacgaagctaaccaaggtacttcaaccaccgatatcaccgtgacgggccagattaacgtcagccacggagaggggattacccttaatgcactgaccactgatggccgcactttggtcaacgttgacgtcaataatattgccagtgaatacgatgccatacgcctctataactataactataatgataactacgccacaggcgtggatgatggcacaggcgcagacaacggcacctcgaccattgatttgatcacccggggcgcgctggtttcgcagcagggctacggaattaatattgaaaccaataccgcagacacctatgtcaccgtgggcggcttggtgcacggcggcaatggcaccgcaatcggcattcatcggcttgataacattcaaacatcggccacgttagagctgcaatctggctatgcccttgaaggcgttacgcaggcactggtcttcaatggcagttatgcggagatcaatgatgccgcgttggatctggcaaacagccatctggtgctggggggaacaggggacgctgctttcgatctcacgcgtattgataaccgtgaagaggccattctggatggcgacccgaaccggatcaccggcttcggtaccctgaccaaaaccaataacagtatctggacgttaaccggcgccaatatggctgacggtgacgccaatgccttcctgtcggccaatatcgccggggggattttggtgctggataacgccacgttgggcctgacgcctgccaccaccatattaaatcgcctcagtgccgccgatatcgccgctgacccgacgctagtggctaccgaaaccggtgcattaaccctggctgaaggcggcgcgctgtcctcactcggtgactcggtcctgagcggcaacctcatcagcgccggtgggatcctgctgtcaaacacctataccggcggcaatggtgccgctaccgacgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtggccggggcgtatgcctacactttacaggccgacggggaagccgccactgcggggcgcaactggtatctctcttcagaactgatgttaaccgagggggtacgctatcaggtgggcgtgccgctgtatgaacaatatccgcaggtgctggccgccctgaataccctgccgacgctgcaacagcgtgtcggtaaccgttacggggcaccgggcgcactggcagatctgaactttgacgataatcaatgggcctggggccgtattgaagggagccaccaggtcaccgacccggcccgatccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggtcttggcaccagcctgacctggtatggcaataacggcgtgtatgtggatggccagttgcagacgatgtggtttgacagcgacctgagctcccgtaccgcagggcatgcggtggccagtggcaataatggccgtgggtatacctcggcgatagaagccggtaaaggttacgcactgggtaacgggttatcgctgactccgcagatgcaggtgacctactcgcgggtcgatttcgataccttccgcgatccgtttgatagcgaagtctcgctgcaagagggtgacagcctgcggggccgcctcggtgtctcactggataaggaaacgacctggagtgcgaaagacggcaccacccgccgctcacacatttacagtcatctcgatctgcacaatgagttcctcaatggcagcaaagtacaggtctcaggggtggagttcgccacccgggatgagcgtcagtcggtggggttaggcgcgggcggtacgtatgaatggcagaatggtcgctacgcggtttacggcaatgtcaatctgctgggggctacacggaatgtcagtgacaactatgccgtcggcggcacgataggtgcacgagtgagctggtaa

SEQ ID NO: 381 - DNA, 3858 bp, Yersinia Sp.
atgcatatacaattcagagagcctatttctacctcacccgctcaaccggatgcagggcgtcaacacctcttcagccgtgttcctgcagccgtgatgaatccgattacattggcaattattgttgcgttctcccccctcgtcttaccacaaaccgcatgggcggcgtgcaatagctcgggggtgggaacctatgtttgcgaaggtgaaaataacaccgcgatatccctgttcggcacggatatcgccgttgagacccggccaggttttggcataacagaacatgaaattacggattctgcgctctcgttaaccggttcgggtaccatcagttacctcgataccaacagttctgcactggataccgacagtcgatattctttgtatattaagaatgacacattaataaccgagcaatcggcatccattaatgttcagagcaacggctccattagcagtggcgtttacattgacaaccagagcagtgacgattcgaccatacgggtagatctctctggcatcttatccagcagcctgagcggcgctccagccctttcaatcttttcatcggcaggcaatgattcaactatcattctgaacacccacgctatttcaggtgttactggcatccaaagcgataataattcacaaaatggagcgaccatcacccacgttgatgttactggtgatattaacgtcgaaaattcaggcgtctcgatccgaaatgctgccaatggtggcaccagcataattaacttcaattcaaagagtattaatacagaatatgacagtttttatattcaaaataccaattatgtaggtggagtgataactgatatcaatattgatggcgatatcagttcagctaatagtcaagcagccaggatttacaattataccaatggcggtcttgcgagccttagatttcgcgcaaataatgtcactggatcgactggcctttatatcgataatagcagccaaaatggcgctgtaaccgatattatattgacgggtgatcttacggctacttcaggatctgctctacaagccaatgcctactcggatgagggaaacatcgagacctctatcaagttgaataacgtttattctttgtatgatgcactcaatattagcgactatacccgatccggaaatatactgcatgaccttgatatttcaggaacgattactgcagaaaacggtaccggaattaaagtgatgggcgcggctggtgaaggcagttctactatgctcatcaatgtgaataatattacttccagcagtcaatcgcttgatatcaacaattacaattttttgggttcagctttttctgccattaccgcgaccgggcatctcacggcggaatggggacaaggggcaatgctccagacccattcctctctgggggatgccaccacgctcatccacttcaatgacatcactgcaatgagcagtggaatatctctcattaacgaagctaaccaaggtacttcaaccaccgatatcaccgtgacgggccagattaacgtcagccacggagaggggattacccttaatgcactgaccactgatggccgcactttggtcaacgttgacgtcaataatattgccagtgaatacgatgccatacgcctctataactataactataactataactataactataactataactataactataactataactataatgataactacgccacaggcgtggatgatggcacaggcgcagacaacggcacctcgaccattgatctgatcacccggggcgcgctggtttcacagcagggctacgggattaatatcgaaaccaataccgcagacacctatgtcaccgtgggcggcttggtgcacggcggcaacggtaccgcaattggcattcatcggctcgaaaatgttcaaaaatcagccacgttagagctgcaatctggctatgcccttgaaggcgttacacaggcactggtcttcactggcagttatgcggagatcaatgatgccgcgttggatctggcaaacagccatctggtgctggggggagcaggggacgctgctttcgatctcacgcgtattgataaccgtgaagaggccattctggatggcgacccgaaccggatcaccggcttcggtaccctgaccaaaaccaacaacagtatctggacgttaaccggctccaatatggctgacggtgacgccaatgccttcctgtcggccaatatcgccggggggattttggtgctggataacgccacgctgggcctgacacctgacgccggggcactgactggccccacagtaaaccgcctcagtgcggccgatatcgccgctgacccgacgttggtggctaccgaaaccggtgcattaaccctgggtgaaggcggcgcgctgtcctcgctcggtgattcggttctgagcggtaacctcatcagcgctggcgggatcctgctgtcaaaccactataccggcggcaatggtaccgctaccgatgatcggctgaccgtgaccgggacttatttgggtgaaaataacggttccggtgaaggggcctggctaacgctggatacggtgctgggggatgacgattctgccaccgaccggttagtgatcaacggcgatgccaccggcaccacctcggtccgggtgaacaatgcgggcggtctgggcgataaaaccctcaatggcatcaacctgatcaccgtggacggtctggcgcaggatgacaccttcctgctggccggggattatgtcaccacggatggctatcaggcggtggtgggcggggcgtatgcctacaccttacaggccgacggggaagccgccactgcggggcgcaactggtatctctcgtcagagctgatgttaaccgagggggtacgctatcaggcgggcgtgccgctgtatgaacaatatccgcaggtgctggccgccctgaataccctgccgacgctgcaacagcgtgtcggtaaccgttacggggcaccgggcgcactggcagacctgaactttgacgataatcaatgggcctggggccgtattgaagggagccaccaggtcaccgacccggcccgctccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggtcttggcaccagcctgacctggtatggcaataacggcgtgtatgtggatggccagttgcagacgatgtggtttgacagcgacctgagctcccgtaccgcagggcatgcggtggccagcggtaacaatggtcgcgggtatacctcagcgatagaagccggtaaaggttacgcactgggtaacgggttatcgctgactccgcagatgcaggtgacctactcgcgggtcgatttcgataccttccgcgatccgtttgatagcgaagtctcgctgcaagagggtgacagcctgcggggccgcctcggtgtctcactggataaggaaacgacctggagtgcgaaagacggcaccacccgccgctcacacatttacagtcatctcgatctgcacaatgagttcctcaatggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgagtgagctggtaa

SEQ ID NO: 382 - DNA, 3894 bp, Yersinia Sp.
atgcatatacaattcagagagcctatttctacctcacccgctcaaccggatgcagggcgtcaacacctcttcagccgtgttcctgcagccgtgatgaatccgattacattggcaattattgttgcgttctcccccctcgtcttaccacaaaccgcatgggcggcgtgcaatagctcgggggtgggaacctatgtttgcgaaggtgaaaataacaccgcgatatccctgttcggcacggatatcgccgttgagacccggccaggttttggcataacagaacatgaaattacggattctgcgctctcgttaaccggttcgggtaccatcagttacctcgataccaacagttctgcactggataccgacagtcgatattctttgtatattaagaatgacacattaataaccgagcaatcggcatccattaatgttcagagcaacggctccattagcagtggcgtttacattgacaaccagagcagtgacgattcgaccatacgggtagatctctctggcatcttatccagcagcctgagcggcgctccagccctttcaatcttttcatcggcaggcaatgattcaactatcattctgaacacccacgctatttcaggtgttactggcatccaaagcgataataattcacaaaatggagcgaccatcacccacgttgatgttactggtgatattaacgtcgaaaattcaggcgtctcgatccgaaatgctgccaatggtggcaccagcataattaacttcaattcaaagagtattaatacagaatatgacagtttttatattcaaaataccaattatgtaggtggagtgataactgatatcaatattgatggcgatatcagttcagctaatagtcaagcagccaggatttacaattataccaatggcggtcttgcgagccttagatttcgcgcaaataatgtcactggatcgactggcctttatatcgataatagcagccaaaatggcgctgtaaccgatattatattgacgggtgatcttacggctacttcaggatctgctctacaagccaatgcctactcggatgagggaaacatcgagacctctatcaagttgaataacgtttattctttgtatgatgcactcaatattagcgactatacccgatccggaaatatactgcatgaccttgatatttcaggaacgattactgcagaaaacggtaccggaattaaagtgatgggcgcggctggtgaaggcagttctactatgctcatcaatgtgaataatattacttccagcagtcaatcgcttgatatcaacaattacaattttttgggttcagctttttctgccattaccgcgaccgggcatctcacggcggaatggggacaaggggcaatgctccagacccattcctctctgggggatgccaccacgctcatccacttcaatgacatcactgcaatgagcagtggaatatctctcattaacgaagctaaccaaggtacttcaaccaccgatatcaccgtgacgggccagattaacgtcagccacggagaggggattacccttaatgcactgaccactgatggccgcactttggtcaacgttgacgtcaataatattgccagtgaatacgatgccatacgcctctataactataactataactataactataactataactataactataactataactataactataactataactataactataactataactataactataatgataactacgccacaggcgtggatgatggcacaggcgcagacaacggcacctcgaccattgatctgatcacccggggcgcgctggtttcacagcagggctacgggattaatatcgaaaccaataccgcagacacctatgtcaccgtgggcggcttggtgcacggcggcaacggtaccgcaattggcattcatcggctcgaaaatgttcaaaaatcagccacgttagagctgcaatctggctatgcccttgaaggcgttacacaggcactggtcttcactggcagttatgcggagatcaatgatgccgcgttggatctggcaaacagccatctggtgctggggggagcaggggacgctgctttcgatctcacgcgtattgataaccgtgaagaggccattctggatggcgacccgaaccggatcaccggcttcggtaccctgaccaaaaccaacaacagtatctggacgttaaccggctccaatatggctgacggtgacgccaatgccttcctgtcggccaatatcgccggggggattttggtgctggataacgccacgctgggcctgacacctgacgccggggcactgactggccccacagtaaaccgcctcagtgcggccgatatcgccgctgacccgacgttggtggctaccgaaaccggtgcattaaccctgggtgaaggcggcgcgctgtcctcgctcggtgattcggttctgagcggtaacctcatcagcgctggcgggatcctgctgtcaaaccactataccggcggcaatggtaccgctaccgatgatcggctgaccgtgaccgggacttatttgggtgaaaataacggttccggtgaaggggcctggctaacgctggatacggtgctgggggatgacgattctgccaccgaccggttagtgatcaacggcgatgccaccggcaccacctcggtccgggtgaacaatgcgggcggtctgggcgataaaaccctcaatggcatcaacctgatcaccgtggacggtctggcgcaggatgacaccttcctgctggccggggattatgtcaccacggatggctatcaggcggtggtgggcggggcgtatgcctacaccttacaggccgacggggaagccgccactgcggggcgcaactggtatctctcgtcagagctgatgttaaccgagggggtacgctatcaggcgggcgtgccgctgtatgaacaatatccgcaggtgctggccgccctgaataccctgccgacgctgcaacagcgtgtcggtaaccgttacggggcaccgggcgcactggcagacctgaactttgacgataatcaatgggcctggggccgtattgaagggagccaccaggtcaccgacccggcccgctccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggtcttggcaccagcctgacctggtatggcaataacggcgtgtatgtggatggccagttgcagacgatgtggtttgacagcgacctgagctcccgtaccgcagggcatgcggtggccagcggtaacaatggtcgcgggtatacctcagcgatagaagccggtaaaggttacgcactgggtaacgggttatcgctgactccgcagatgcaggtgacctactcgcgggtcgatttcgataccttccgcgatccgtttgatagcgaagtctcgctgcaagagggtgacagcctgcggggccgcctcggtgtctcactggataaggaaacgacctggagtgcgaaagacggcaccacccgccgctcacacatttacagtcatctcgatctgcacaatgagttcctcaatggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgagtgagctggtaa

SEQ ID NO: 383 - DNA, 3780 bp, Yersinia Sp.
atgtatatacaatttagagagcctatttctacctcacccgctcaaccggatgcagggcaccgacacctcttcagttgtgctcctgcagccgcgattaatcccatcacattggcgattattgttgcgttctccgccctcgtcttgccacaaaccgcacgggcgtcgtgtaatagctcgggggtgggcacctatgtttgcgaaggtgaaaatcatgctgggatcatcttgagcggcacagatattgccgttgagacccagcccggttttagcatcacagagcccggaggtgcggatcctgcgctttcgttaattggttctggtgccatcagctaccttgataccaacaggtctgcgcttgataccaccggtgccgattctttgtatatccagaatgatacctcgatggctgggcaatcgacgtccattaatattcagtccaacagttcgattggtagcggtatcaacattaacaaccgcagtggcgctgatgcggctatacagatagatctctccggcacgttatccggtaaccaaaatggctctgcggccctctcaatccattcatcggctgagggtaattctgcgttcatattgaatctcgatgctctgtctggttctatgggtctgcagagctacaatgattcacgcagtggaatagccaccactaatatcaatattgtcaacgatattaacgtcgaatattcgggtgcctctattaacaacaccggcaatggcgagaccagcataattaatttcaactcaaaaaatatcacgacagaattcgatggcttgaatgtttataatacgaattatgctggggcggcgattaccaatatcaatattgatggcgatatccgttcagccaatagccaagctgccactttttataatagtgcttatgagggtccttcaagccttaggcttcgggcgaaccatgtcacgggtgaatatgctggcctttatatcagcaatgatagccgtaagagctcagcgataaccgatatcctgttgaccggggatcttacgtctacttcaggggcgggtctcgtgttcaattcctatgtggaagaggacgacatcggggcatctatcaagttaaataatatctattcttactacgaagcgctcagtttaagtgcaaataccttaaatggcgacatgcagtttgaccttgatatttcaggcgatattgttaacgaatatggtaccggaattttaatgatggggatggcttctgaaggtaactccaccataatcatcaatgcgaataatattaattccggcagccaatcgctcaaagttaacaactatagccatttaggaaccgccgtttctgacattaccgcaaccgggcatctcgtctctgaacagggggtaggggcaatattcagtacctatgtcagtcagggggatgctatcgctgtcattaatttaaatgacatcactgctgcgggcagtagtgtagagatagacaccatagcgagtgaggggaattcaatcacctatctcaccgtgacgggccagattaacgccagtaacggagagggtattacccttagttcgcaagccactgacggcagtaccctggtcaacattgacgtcaataatatcgccagtgaatacgatgctatttacctccataactctgttactggcgtagacaacggcacatcgaccattgatctgatcacccggggcgcgctggtttcgcagcagggctacgggattaatcttgaaaccaataccgcagacacctatgtcaccgtgggcggcttggtgcacggcggcaacggtaccgcaattggcattcatcggctcgaaaatgttcaaacatcggccacgttagagctgcaatctggctatgcccttgaaggcgttacacaggcactggtcttcactggcagttatgcggagatcaatgatgccgcgttggatctggcaaacagccatctggtgctggggggaacaggggacgctgctttcgatctcacgcgtattgataaccgtgaagaggccattctggatggcgacccgaaccggatcaccggcttcggtaccctgaccaaaaccaataacagtatctggacattaaccggatccaatatggccgacggtgacgccaatgccttcctgtcggccaatatcgccggggggattttggtgctggataacgccacgctgggcctgacacctgacgctggggcactgactggagccacagtaaaccgcctcagtgctgccgatatcgccgctgacccgacgcgggtggctaccgaaaccggtgcattaaccctggctgaaggcggcgcgctgtcctcgctcggtgactcggttctgagcggcaacctcatcagcgccggcgggatcctgctgtcaaaccactataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtggccggggcgtatgcctacaccttacaggccgacggggaagccgctaccgcaggccgcaactggtatctctcgtcagaactgatgctaaccgagggggtacgctatcaggtgggggtgccgctgtatgaacaatatccgcaggtgctggccgccctgaacactctgccgacgctgcaacagcgtgtcggtaaccgttacggggcaccgggtgcgctggcagacctgaactttgacgataatcaatgggcctggggccgtattgaagggagccaccaggtcaccgacccggcccgctccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcacaggttacggtcttggcaccagcctgacctggtatggcaataacggcgtgtatgtggatggccagttgcagacgatgtggtttgacagcgacctgagctcccgtaccgcagggcatgcagtggccagcggtaacaatggttgcgggtatacctcggcgatagaagccggtaaaggttacacactgggtcacggcttgtcgctgactccgcagatgcaggtgacctactcgcgggtcgatttcgataccttccgcgatccgtttgatagcgaagtctcgctgcaagagggtgacagcctgcggggccgcctcggtgtctcactggataaggaaacgacctggagtgcgaaagacggcaccacccgccgctcacacatttacagtcatctcgatctgcacaatgagttccttaacggcagtaaagtgcaggtctcgggggtggagttcgccacccgggatgagcgtcagtcggtggggttaggcgcgggcggtacgtatgaatggcagaatggtcgctacgcggtttacggcaatgtcaatctgctgggggctacacggaatgtcagtgacaactatgccgtcggcggcacgataggcgcacgggtgagctggtaa

SEQ ID NO: 384 - DNA, 3765 bp, Yersinia Sp.
atgtatatacaatttagagagcctatttctacctcacccgctcaaccggatgcagggcaccgacacctcttcagttgtgctcctgcagccgcgattaatcccatcacattggcgattattgttgcgttctccgccctcgtcttgccacaaaccgcacgggcgtcgtgtaatagctcgggggggggcacctatgtttgcgaaggtgaaaatcatgctgggatcatcttgagcggcacagatattgccgttgagacccagcccggttttagcatcacagagcccggaggtgcggatcctgcgctctcgttaattggttctggtgccatcagctaccttgataccaacaggtctgcgcttgataccaccggtgccgattctttgtatatccagaatgatacctcgatggctgggcaatcgacgtccattaatattcagtccaacagttcgattggtagcggtatcaacattaacaaccgcagtggcgctgatgcggctatacagatagatctctccggcacgttatccggtaaccaaaatggctctgcggccctctcaatccattcatcggctgagggtaattctgcgttcatattgaatctcgatgctctgtctggttctatgggtctgcagagctacaatgattcacgcagtggaatagccaccactaatatcaatattgtcaacgatattaacgtcgaatattcgggtgcttctattaacaacaccggcaatggtgagaccagcataattaatttcaactcaaaaaatatcacgacagaattcgatggcttgaatgtttataatacgaattatgctggggcggcgattaccaatatcaatattgatggcgatatccgttcagccaatagccaagctgccactttttataatagtgcttatgagggtccttcaagccttaggcttcgggcgaaccatgtcacgggtgaatatgctggcctttatatcagcaatgatagccgtaagagctcagcgataaccgatatcctgttgaccggggatcttacgtctacttcaggggcgggtctcgtgttcaattcctatgtggaagaggacgacatcggggcatctatcaagttaaataatatctattcttactacgaagcgctcagtttaagtgcaaataccttaaatggcgacatgcagtttgaccttgatatttcaggcgatattgttaacgaatatggtaccggaattttaatgatggggatggcttctgaaggtaactccaccataatcatcaatgcgaataatattaattccggcagccaatcgctcaaagttaacaactatagccatttaggaaccgccgtttctgacattaccgcaaccgggcatctcgtctctgaacagggggtaggggcaatattcagtacctatgtcagtcagggggatgctatcgctgtcattaatttaaatgacatcactgctgcgggcagtagtgtagagatagacaccatagcgagtgaggggaattcaatcacctacctcaccgtgacgggccagattaacgccagtaacggagagggtattacccttagttcgcaagccactgacggcagcaccctggtcaacattgacgtcaataatatcgccagtgaatacgatgctatttacctccataactctgttactggcgtagacaacggcacatcgaccattgatctgatcacccggggcgcgctggtttcgcagcagggctacgggattaatattgaaaccaataccgcagacacctatgtcaccgtgggcggcttggtgcacggcggcaacggtaccgcaattggcattcatcggctcgaaaatgttcaaacatcggccacgttagagctgcaatctggctatgcccttgaaggcgttacacaggcactggtcttcactggcagttatgcggagatcaatgatgccgcgttggatctggcaaatagccatctggtgctgggcggaacaggagatgctgttttcgatctcacgcgtattgataaccgtgaagaggccattctggatggcgacccgaaccggatcaccggtttcggcaccctgaccaaaaccaacaacagcatctggacattaaccggatccaatatggccgacggtgacgccaatgccttcctgtcggccaatatcgccggggggattttggtgctggataacgccacgttgggcctgacgcctgccaccaccatattaaatcgcctcagtgccgccgatatcgccgctgacccgacgcgggtggctaccgaaaccggtgcattaaccctggctgaaggcggcgcgctgtcctcgctcggtgactcggttctgagcggcaacctcatcagcgctggcgggatcctgctgtcaaaccactataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaacccgcaatggcatcaatctgatcaccgtggacggtctggcgcaggatgacaccttcctgctggccggggactatgtcaccacggatggctatcaggcggtggtggccggggcgtatgcctacaccttacaggccgacggggaagccgctaccgcaggccgcaactggtatctctcgtcagaactgatgctaaccgagggcgtgcgctatcaggtgggcgtgccgctgtatgaacaatatccgcaggtgctggccgccctgaataccctgccgacgctgcaacagcgtgtcggtaaccgttacggggcaccgggcgcactggcagatctgaactttgacgataatcaatgggcctggggccgtattgaagggagccaccaggtcaccgacccggcccgatccaccagcggttcacaacgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggtcttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacgcactgggtaacgggttgtcactgaccccgcagatgcaggtgacctactcgcgggtcgatttcgataccttccgcgatccgtttgatagcgaagtctcgctgcaagagggtgacagcctgcggggccgcattggtgtctcactggataaggaaacgacctggagcgcgaaagacggcaccacccgccgctcacacatttacagtcatctcgatctgcacaatgagttccttaacggcagtaaagtgcaggtctcgggggtggagttcgccacccgggataagcgtcagtcggtgggtttaggcgcgggtggcacgtatgaatggcagaatggtcgctacgcggtttacggcaatgtcaatctgctgggggctacacggaatgtcagtgacaattatgccgtcggcggcacgataggcgcacgggtgagttggtaa

SEQ ID NO: 385 - DNA, 3780 bp, Yersinia Sp.
atgtatatacaatttagagagcctatttctacctcacccgctcaaccggatgcagggcaccgacacctcttcagttgtgctcctgcagccgcgattaatcccatcacattggcgattattgttgcgttctccgccctcgtcttgccacaaaccgcacgggcgtcgtgtaatagctcgggggtgggcacctatgtttgcgaaggtgaaaatcatgctgggatcatcttgagcggcacagatattgccgttgagacccagcccggttttagcatcacagagcccggaggtgcggatcctgcgctctcgttaattggttctggtgtcatcagctaccttgataccaacaggtctgcgcttgataccaccggtgccgattctttgtatatccagaatgatacctcgatggctgggcaatcgacgtccattaatattcagtccaacagttcgattggtagcggtatcaacattaacaaccgcagtggcgctgatgcggctatacagatagatctctccggcacgttatccggtaaccaaaatggctctgcggccctctcaatccattcatcggctgagggtaattctgcgttcatattgaatctcgatgctctgtctggttctatgggtctgcagagctacaatgattcacgcagtggaatagccaccactaatatcaatattgtcaacgatattaacgtcgaatattcgggtgcctctattaacaacaccggcaatggcgagaccagcataattaatttcaactcaaaaaatatcacgacagaattcgatggcttgaatgtttataatacgaattatgctggggcggcgattaccaatatcaatattgatggcgatatccgttcagccaatagccaagctgccactttttataatagtgcttatgagggtccttcaagccttaggcttcgggcgaaccatgtcacgggtgaatatgctggcctttatatcagcaatgatagccgtaagagctcagcgataaccgatatcctgttgacgggggatctgacgtctacttcaggggcgggtctcgtgttcaattcctatgtggaagaggacgacatcggggcatctatcaagttaaataatatctattcttactacgaagcgctcagtttaagtgcaaataccttaaatggcgacatgcagtttgaccttgatatttcaggcgatattgttaacgaatatggtaccggaattttaatgatggggatggcttctgaaggtaactccaccataatcatcaatgcgaataatattaattccggcagccaatcgctcaaagttaacaactatagccatttaggaaccgccgtttctgacattaccgcaaccgggcatctcgtctctgaacagggggtaggggcaatattcagtacctatgtcagtcagggggatgctatcgctgtcattaatttaaatgacatcactgctgcgggcagtagtgtagaaatagacaccatagcgagtgaggggaattcaaccacctatctcaccgtggtgggccagattaacgccagtaacggagagggtattacccttatttcgcaagccactgatggcagcaccctggtcaacattgacgtcaataatatcgccagtgaatacgatgctatttacctccataactctgttactggcgcagacaacggcacatcgaccattgatctgatcacccggggcgcgctggtttcgcagcagggctacgggattaatcttgaaaccaataccgcagacacctatgtcaccgtgggcggcttggtgcacggcggcaacggtaccgcaattggcattcatcggctcgaaaatgttcaaaaatcagccacgttagagctgcaatctggctatgcccttgaaggcgttacacaggcactggtcttcactggcagttatgcggagatcaatgatgccgcgttggatctggcaaacagccatctggtgctggggggagcaggggacgctgctttcgatctcacgcgtattgataaccgtgaagaggccattctggatggcgacccgaaccggatcaccggcttcggtaccctgaccaaaaccaacaacagcatctggacattaaccggatccaatatggccgacggtgacgccaatgccttcctgtcggccaatatagccggggggattttggtgctggataatgccacgctgggcctgacacctaccgccggggcactgactggccccgcagtaaaccgcctcagtgccgccgatatcgccgctgacccgacgcgggtggctaccgaaaccggtgcattaaccctgggtgaaggcggcgcgctgtcctcgctcggtgattcggttctgagcggtaacctcatcagcgctggcgggatcctgctgtcaaacacctataccggcggcaatggtgccgctaccgatgatcggctgaccgtgaccgggacttatttgggtgaaaataacggttccggtgaaggggcttggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaacctgatcaccgtggacggtctggcgcaggatgacaccttcctgctggccgggaattatgtcaccacggatggctatcaggcggtggtgggcggggcgtatgcctacaccttacaggccgacggggaagccgctaccgagggccgcaactggtatctctcgtcagaactgatgttaaccgagggggtacgctatcaggcgggcgtgccgctgtatgaacaatatccgcaggtgctggccgccctaaatactctgccgacgctgcaacagcgtgtcggtaaccgttacggggcaccgggcgcgctggcagagttgaactttgacgataatcaatgggcctggggccgtattgaagggagccaccaggtcaccgacccggcccgctccaccagcggttcacaacgtgagattgatgtgtggaagttgcagaccggcattgatgtgccgttgtatcagagccaggacggttcactgctgaccggcggggtgaacttcacctacggaaaagccaaagcggatatccactcattctttggtgatggccgcatcaacagcgcgggttacggtcttggcaccagcctgacctggtatggcaataacggcgtgtatgtggatggtcagttgcaaacgatgtggtttgacagcgacctgagctcccgtaccgaggggcatgcggtggccagcggtaacaatggtcgcgggtatacctcggcgatagaagccggtaaaggttacgcactgggtaacgggttgtcactgaccccgcagatacaggtgacctactcgcgggtcgatttcgataccttccgcgatccgtttgatagcgaagtctcgctgcaagagggtgacagcctgcggggccgcattggtgtctcactggataaggaaacgacctggagtgcgaaagacggcaccacccgccgctcacacatttacagtcatctcgatctgcacaatgagttcctcaacggcagtaaagtgcaggtctcgggggtggagttcgccacccgggatgagcgtcagtcggtggggttaggcgcgggcggtacgtatgaatggcagaatggtcgctacgcggtttacggcaatgtcaatctgctgggggctacacggaatgtcagtgacaattatgccgtcggcggcacgataggtgcacgagtgagctggtaa

SEQ ID NO: 386 - DNA, 3807 bp, Yersinia Sp.
atgttgaaacatttcagactgggtctttttaccgcaaatgttcaggcggatacagggagccaacactcctttagccgtgttccagcagccgcgattaatcccataacattagcgattgttgtggcgttttctactattgctttaccaccaatggcattagcagcatgcaccagccccggggtgggaacctatgtctgcgaaggtgaaaataccgacggcatcatcctgagcggcacggatattgcggttgagacccaacctggtttcagcataatagttcctgaaaatggagaccctgcactctcgctagtcggttctggcaccatcagctaccttgataccaacagttctgcgcttgataccacgggtgccgattctttgtatatccagaatgatacgcacaccactgggcaatcgtcgtccattaatgttcagacaaacggttcaatgggtagcggtatcaatattagcaaccatagcggtgccgactcgacagtacaggtggatgtttccggcacattatttggtgatctaaatggttctcccgcccttttaatctattcatcggcggagaataattccactattctcatgaatatcaatactattttcggcgacgtgggtattcgaagcgataacacttcattcaatggaacagccatcactaacgttgatattgctaatgatattaatgctacatattcgggtgccactatcaacaacagcggtagcggcggtaccagtgtggttaatttcaactcaaaaagcatcattacagaattggacgccttaaatatttataataccaattattcaggggcggttataaccaatgtcgatatcgatggtgatgtcatttcaacgactagccaggcgacctctttttataacgatgcctacaacggctctgcaaactttacgtttcgtgcgaacaatgtcactggtgaatattccggcatttctatcaataatagcagtcataacagtgctaataacaaccatgataatgcggtgataaccgatatcctgttgacgggggatcttacgtctacttcaggatcgggcctccagataaactcttatatggacgatggggatatcaaggtatcagcccagttggagaacatctattcttactatgaagccctcagtgtgcgtgcggataccctaactggcaacctgcagtttaacatcgatgtttcgggcaatattgttgctgaaaatggcctcggtttcatggtgatggggggcgcttccgaaggcaactccactatgatcatcaatgcgaataacattagttctggtagtcaagcactcaatatttacaactatagcggtttaggttcggcatttactgccgttaccgcaaccgggcatctcgtctctgaacaggggataggggcaatgttcagtacctatgtcagtcaaggggatgctaccgctgtcatcaatttaaatgacatcactactgcgggcagtggtgtaaagatagacaccatagcgaatggggggaattcaaccacctatctcaccgtggtgggccagattaactctagtttgtatgatggtattgatcttcgtgcgacggctactgaaggtaataccctggtcagcattgacgtcaataatatcgccagtgaatacgatgctatccacctcgataacaagaactacaccacaggcgcagacaacggcacctcgaccattgatctgatcacccggggcgcgctggtttcgcagcagggctacggaattaatattgaaaccaataccgcagacacctatgtcaccgtgggcggcttggtgcacggcggcaatggcaccgcaatcggcattcatcggcttgataacattcaaacatcggccacgttagagctgcaatctggctatgcccttgaaggcgttacgcaggcactggtcttcaatggtagttatgcggagatcaatgatgccgcgctggatctggcaaacagccatctggtgctgggcggagcaggagacgccgctttcgatctcacgcgtattgataaccgtgaagaggccattctggatggcgacccgaaccggatcaccggcttcggtaccctgaccaaaaccaacaacagcatctggacgttaaccggcgccaatatggccgacggtgacgccaatgccttcctgtcggccaatatcgccggggggattttggtgctggataacgccacgctgggcctgacacctgacgctggggcactcactggagccacagtaaaccgcctcagtgctgccgatatcgccgctgacccgacgctagtggctaccgaaaccggtgcattaaccctggctgaaggcggggcgttgtcctcgctcggtgactcggttctgagcggtaaccttatcagcgccggtgggatcctgctgtcaaaccactataccggcggcaatggtgccgctaccgacgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaacctgatcaccgtggacggtctggcgcaggatgacaccttcctactggccggggactatgtcaccacggatggctatcaggcggtggtgggcggggcgtatgcctacaccttacaggccgacggggaagccgccactgcggggcgcaactggtatctctcttcagaactgatgctaaccgagggggtacgctatcaggtgggcgtgccgctgtatgaacaatatccgcaggtgctggccgccctgaacaccctgccgacgctgcaacagcgtgtcggtaaccgttacggggcgccgggcgcgctggcagacctggactttgacaataatcaatgggcctggggccgtattgaagggagccaccaggtcaccgacccggcccgatccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcgcaggttacggtcttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacgcactgggtaacgggttgtcactgaccccgcagatgcaggtgacctactcgcgggtcgatttcgataccttccgcgatccgtttgatagcgaagtttcgctgcaagagggtgacagcctgcggggccgcatcggtgtctcactggataaggaaacgacctggagcgcgaaagacggcaccacccgccgctcacacatttacagtcatctcgatctgcacaatgagttcctcaatggcagtaaagtgcaggtctcgggggtggagttcgccacccgggatgagcgtcagtcggtggggttaggcgcgggcggcacctatgaatggcagaatggtcgctacgcggtttacggcaatgtcaatctgctgggggctacacggaatgtcagtgacaactatgccgtcggcggtacgataggtgcacgggtgagctggtaa

SEQ ID NO: 387 - DNA, 3780 bp, Yersinia Sp.
atgcatatacaattcagagagcttatttctacctcacccgcgcaaccggacgctgggcatcaacacctcttcagccgtgttcctgcagccgcgattaatcccattacattggcgattattgttgcattctccaccctcgtcttgccacaaaccgcacgggcgacgtgcagtagctccggggtgggaacctatgtttgcgaaggtgaaaataacgccgggatcatcttgaatggcacggatattgccgttgagacccggccaggttttggcataacagagcctggaggggcggaacctgcgctctcgttaattggttctggtgccatcagctaccttgataccaacaggtctgcgcttgataccaccggtaccgattctttgtatatccagaatgatacctcgatgactgggcaatcgacgtccattaacattcagtccaacagttctattggtaacggtatcaacattaacaaccgcagtggcgctgatgcgactatacagatagatctctcaggcacgttatccggtaacctaaatggctctgctgccctttcaatccattcatcggctgagggtaattctgcgttcacattgaatctcgatgctctgtctggttctatgggtctccaaagctacaatgattcacgcagtggaatagtcaccactaatatcaacatcgccaacgatattaacgttgagtattcgggtgcctctattaacaacacgggcaatggagagaccagcataattagtttcaactcaaaaaatatccgtacagaactcgatggcttgaatgtttataatactaattattcaggggcagtgataaccgatatcaatatcgatggcgatatcagttcagccaatagccaagctgccactttttataatagtgcttatgatggtccttcaagctttaggcttcgggcgaaccatatcacgggtgaatatgctggcctttatatcagcaatgatagccgtaatagctcagtgataaccgatatcctgttgacgggggatattacgtctacttcaggggcgggtttcgtgttcaattcctatgtggaagggggcgacagcggtgcatctatcaagttaaataacatctattcttactacgaagcgcttagtttgagtgcgaataccgtcaatggcgatatgcggtttgaccttgatatttcaggcgatattgttaacgaatatggtaccggaattttaatgatggggggaacttctgaaggtaactccaccataataatcaatgcgaataatattaattccggcagccaatcgctcagtgttagcaactatagctatttaggcgctgccttttctgacattactgcgagtgggcatctcctctctgaacatggacaaggagccattatcaatactacctccaatcaggggaaggccaccactgtcatcaatttaaatgacatcaccgccgtgggcagtagtatagagatatacaccgcggcgaatgagggggattcaaccaccgatctcaccgtgacgggccagattaactccagtaacggggagggtattacccttcatgcactggccactgacggcagcactctggtcaacgttgacgtcaataatattgccagtgaatacgatgctatttacctccataactcggttaccggcgtggacaacgacacatcgaccattgatttaaccacccggggcgcactggtttcgcagcagggctacgggattaatatcgacaccaataccgcagacacctatgtcaccgtgggcggcctggtgcacggcggcggcggcaccgcaattggcatccatcggcttgataacattcaaaaatcagccacgttagagctgcaatctggctatgcccttgaaggggccacgcaggcactggtattcaatggcagttacgcggatatgaatgatgccgcgctggatctggccaacagccatctggtgctgggtggaacaggagccgccgcgttcgatctcggccgtattgataaccgcgaagaggctattctggatggcgattcgaaccggatcaccggtttcggcaccctgaccaaaaccaacaacagcatctggacgctaaccggctccaatatggctgatggtgacgccaatgccttcctgtctgccaatatcgccggggggattttggtgctggataacgccacgctgggcctgacgccggtcaccggggcactcacgagcgccgcattaaaccgcctcagtgccgctgatatcgccgccgacccgacgctggtggccactgaaaccggtgcattaaccctgggcgaaggtggcgcgctgtcctcgcttggtgactctgttctgagcggtaaccttattagtgccggcgggatcctgctgtcaaacagctataccggcggcaatggagccgctacggatgatcggttgaccgtgaccgggacttattttggtgaaagtaacggttccggcgaaggtgcctggctggcacttgatacggtgctgggcgatgacgattctgccaccgaccggttagtgatcaacggcgatgccaccggcaccacctcggttcgggtgaacaatgcgggcggcctgggcgataaaaccctcaatggcatcaacctgatcaccgtggacggtctggcgcaggatgacaccttcctgctggcaggggactatgtcaccacggatggctaccaggcggtggtgggcggggcgtatgcctataccttgcaggccgacggggaaggcaccacggcgggccgcaactggtatctctcttcagaactgatgctaaccgagggcgttcgctatcaggcgggcgtgccgttgtatgaacaatatccgcaggtgctggccgccctgaataccctgccgacgctgcaacagcgtgtcggtaaccgttacggggcaccgggcgcgctggcagcactgagttttgacgataatcaatgggcctggggccgtatcgaagggagccgtcaggtcactgacccggcccgctccaccagcggtgcacagcgtgagattgatgtgtggaagttgcagaccggcattgatgtgccgttgtatcagagccagggcggttcactgctgaccggcggggtgaacttctcctacggtaaagccaaagcagatatcaacgcgttctttggtgatggcagcattaatagctcgggttacggtcttggcaccagcctgacctggtatggcaataacggcgtgtatgtggatggccagttacagaccatgtggtttgacagtgatttaagctccagcaccgcggggcatgccttgatcagcgggaataatggccgtgggtatacctcggcggtagaaacgggtaaacgttatgctctgggtaacggggtgtcgctgaccccgcagatgcaggtgagctattcacgggtggatttcgataccttccgcgatacgtttgatagcgaagtttcactgcaagagggtgatagcctgcgggggcgtatcggtgtttccctggataaggaaacggcctggagcgcgaaagacggcagcacccgccgctcacacatttacagccatctcgatctgcacaatgagttcctcaacggcagtaaagtgcaggtttcgggtattgagttcgctacccgggatgagcgccagtcagtaggtttaggcgcgggcggcacgtatgaatggcagaatgggcgctatgcaatttacggcaatgtcaatctgctgggcgctacgcggaatgtcagtgacaactatacggttggcggcacaataggcgcacgggttagctggtaa

SEQ ID NO: 388 - DNA, 1095 bp, Bacillus Sp.
atgataaaaaatggaaaggagatctgttgtatgcctaacctagaaaaagggatcgcctataatattgcgctagggacagatccaagtttagtatttgatatattaggaaatagtactgaatttggttcaatagtagggttatatgcaaaaggtcagaatagtatcaatcaacaatttttcttttttgagctagatggaggaagaatggcaattgttccaagaaatagtgggagacctcttgaacctggatttggagccacgccagatactctgattgttcaaggagaatggacgggtctctcgagtcaacagtgggggttacaggataaaacggcatccagtgttcatatttttaatcaaagtaatggactcgttgtaagttatggacgtaacgaccaagaccagtttccggaattgaatacaccgaatccatccggtcctgctcctgagagagcctggtatcttgaacctgcctatcaagctatattaccaaattttgttccgacaacatctatctattctccaccacaatattcttctgggatatatgaagtattaccagatcagtcggaagttgctaccgtatcaaatgctctcataccatgtattttagtcaatgatggtgcgttaagtcctgaaacaaaagtgcaacaatctccttattatttgctgatcaaacaacaattttggcaaaaagcagcattcggtacagtttctccaaactctatcagagaattttcatttaaagcaggtaccactttcgaagatcaaaaatcgatgtctgatacaatcaatatgacagtgggtggagattttggattacaatttaatgaggtaagtacaaatgccaagtttggaatttcgcaacaaattcaaacggcagtcagtacgacaaatgaagaattatcagaattaacagaaacgctttcatataataacattcagaaagataccttagtaggtgtttctatctatcaacttgtgacacgatatgttttataccgagcaaacggttcattagtcgctcaaccttggaaatttattgataatgcatcagcagtgactgtgatcaccgagcaaccaatcggtgtataa

SEQ ID NO: 389 - DNA, 2463 bp, Brevibacillus Sp.
atgaaattacctaaaatgtataagtgtttattagctactgcactcctcggttcattcacctcctatccagagctatcacatgcggcttcaagcgagaaagaaataataaacgaccaagaagcgaattttaaaggcctattgggctactacttcaatgataaagagttaaaagaaaccgcactgatttctaattctgagtctggagatctattcgttgataacgatcaaatcgatgatatgttacctgatgaattaaaacaatttcaatctgccatgtggagaggatttattaaggtagaaaaatcaggtgaatatacgttctccacgtctgataatgaccacaccatgctatggatagatgatcaccaagttatcgatcactcctccgctacgcaaaaaatcgaattaaaaaaagggaagctttataaaataaaaatcacttatcagccagaatcctcctctgctaacgaatttggcttacagcttaactggattactccacaaggaacggaagaaatcattccagaaggaaatctactgcttcctgacataaaaaatcaaccagagaatgaatctagcagaaaaaaaagaagtatttcaacttctgatgacggagttgaagatagtgatggtgacggcatccctgattccctcgaaatcgaaggatacaccttggatgttaagaataaaaaacttatcctaatgccttggattgaaaaagttcatggaaaaaaacgtacgaaatctggagcaccgttaacaaaatatacatcttcacctatgaaatggagcaccgcatctgatccatatagcgatttcgccaaagtatcaggaatgattgataaaaaggtaaaagtgaaacatccgttgatcgcggcgtatcctaatttacaggttcatatggacaaatttattatttcaaaaaatagaaatgaaacgctagaaaatggcgggaatacaagtagttcgatcagtggaagtacttccacaagtaatactcattcaacagaagcttctgttggggcggaagttcatgcttccttatttaactttggcggaagtgtatccactaattttagcgatagtaattcacagaccgtaaccattgatcgttcaagctctgagagtttgggaagaaactggtccaaatccttaggtttaaatgcaggagaggctgcctattttaatgcaaacattcgctatgtgaataatggtacggcacctatttatgaagcagcacctactacttcactagtactagggaaaaacgataccattgcaacgataaaagcaaaagagaatcacctagcaaacgtagtgttaccagaccgtttttatccagataaagatcaagcagctatttctctacaaaccaaagacgatttcggttctagcccgatcacaatcaataacgatcagcttactattctggagcagacacgacaaatgcgcttggaaacagatcaggtttccggttatgtaggagtaattgatcctaaaacaaaattaattgtggtagataaagataaacagtggagtcatattatccctcaaattgaggaaactactgctcgactaatcttaaaaacaccagacaattcagagctggaaagacgagtagctgctgttgatcccgatgactacactgaacaaacgaagccagatgttacattaggagaagcgctccaattggcttttggttttgaggacaagcaaggaaaattatcttacaacaatacgagtatagatgattttagattggtgtttgatgaagaaactgctgaaaatatagaaaaacaattagaagatatggaaacaaaaaatatctataacgtccaactacatgctcgaatgaatatattaatttcaccgaagaaggatgaacctggtgttcatgaagggttatctagctgggaaatagatggggaagacaattactataaatatgatgtgctacaaactggctggcaaacgataaatgggaaaaagtattattttaatgaaaatggcactttagtacccaacaaagtaattgaggatggaacctatcaaatcaatacagcattaaaaaatacaagtctagttgattggaatagaagcgataataatatcacagtgtgggaaacgaacgatggaaataatcaaaaatggaaattgaagtatgatgactctcaacaagcttatgtgattcgaagcgtagaaaataacgataaaattatggcttggaatgcttatcaggattctactaatgtatttgctacagcgtttgaaggtaaacccgaacatttttggattcctgaattgctaggtaatgatttctatatcttaaaaaacaagaaagatccgacaaaagtgttggatgtagatggttcaggcacttcgaacgggtccaacattcaggtaagtgattataaaggtactgataatcaaaagtggaaattagaacaattggaagcaaattag

SEQ ID NO: 390 - DNA, 2463 bp, Brevibacillus Sp.
atgaaattacctaaaatgtataagtgtttattagctactgcactcctcggttcattcacctcctatccagagctatcacatgcggcttcaagcaagaaagaaataataaacgaccaagaagcgaattttaaaggcctattgggctactacttcaatgataaagagttaaaagaaaccgcactgatttctaattctgagtctggagatctattcgttgataacgatcaaatcgatgatatgttacctgatgaattaaaacaatttcaatctgccatgtggagaggatttattaaggtagaaaaatcaggtgaatatacgttctccacgtctgataatgaccacaccatgctatggatagatgatcaccaagttatcgatcactcctccgctacgcaaaaaatcgaattaaaaaaagggaagctttataaaataaaaatcacttatcagccagaatcctcctctgctaacgaatttggcttacagcttaactggattactccacaaggaacggaagaaatcattccagagggaaatctagtgcttcctgacataaaaaatcaaccagagaatgaatctagcagaaaaaaaagaagtatttcagcttctgatgacggagttgaagatagtgatggtgacggcatccctgattccctcgaaatcgaaggatacaccttggatgtcaagaataaaaaacttatcctgatgccttggattgaaaaagtccatggaaaaaaacgcacgaaatctggagcaccgttaacaaaatatacatcttcacctatgaaatggagcaccgcatctgatccatatagcgatttcgccaaagtatcaggaatgattgataaaaaggtaaaagtgaaacatccgttgatcgcggcgtatcctaatttacaggttcatatggacaaatttattatttcaaaaaatagaaatgaaacgctagaaaatggcgggaatacaagtagttcgatcagtggaagtacttccacaagcaatactcattcaacagaagcttctgttggggcggaagttcatgcttccttatttaactttggcggaagtgtatccactaattttagcgatagtaattcacagaccgtaaccattgatcgttcaagctctgagagtttgggaagaaactggtccaagtccttaggtttaaatgcaggagaggctgcctattttaatgcaaacattcgctatgtgaataatggtacggcacctatttatgaagcagcacctactacttcactagtactagggaaaaacgataccattgcaacgataaaagcaaaagagaatcacctagcaaacgtagtgttaccagaccgtttttatccagataaagatcaagcagctatttctctacaaaccaaagacgatttcggttctagcccgatcacaatcaataaggatcagcttactattctggagcagacacgacaaatgcgcttggaaacagatcaggtttccggttatgtaggagtaattgatcctaaaacaaaattaattgtggtagataaagataagcagtggagtcatattatccctcaaattgaggaaactactgctcgactaatcttaaaaacaccagacaattcagagctggagagacgagtagctgctgttgatcctgatgactacactgaacaaacgaagccagatgttacattaggagaagcgctccaattggcttttggttttgaggacaagcaagggaaattatcttacaacaatacgagtatagatgattttagattggtgtttgatgaagaaactgctgaaaatatagaaaagcaattagaagatatggaaacaaaaaatatctataacgtccaactacatgctcgaatgaatatactaatttcaccgaagaaggatgaatctggtgatcatgaagggttatctagctgggaaatagatggggaagacaattactataaatatgatgtgctgcaaactggctggcaaacgataaatgggaaaaagtattattttaatgaaaatggcactttagtacccaacaaagtaattgaggatggaacctatcaaatcaatacagcattaaaaaatacaagtctagttgattggaatagaagcgataataatatcacagtgtgggaaacgaacgatggaagtaatcaaaaatggaaattgaaatatgatgactctcaacaagcctatgtgattcgaagcgtagaaaaaaacgataaaattatggcttggaatgcttatcaggattctactaatgtatttgctacagcgtttgaagggaaacccgaacatttttggattcctgaattgctaggtaatgatttctatatcttaaaaaacaagaaagatcctactaaagtgttggatgtagatggttcaggcacttcaaacgggtccaacattcaggtacttgattacaaaggcactgataatcaaaaatggaaattagaacaagtggaagcaaattag

SEQ ID NO: 391 - DNA, 2466 bp, Brevibacillus Sp.
atgaaattacctaaaatgtataagtgtttattagctactgcactcctcggttcattcacctcctatccagagctatcacacgcggcttcaaacgaaaatgaaataataaacgaccaagaagcgaattttaaaggcttattgggctactacttcaatgataaagagttaaaagaaaccgcactgatttcaaattctgagtctggagatctattcgttgataacgatcaaatcgatgatatgttacctgatgaattaaaacaatttcaatccgctatgtggagaggatttattaaggtagaaaaatcaggtgaatatactttctccacgtctgataatgaccacaccatgctatggatagatgatcaacaagttatcgatcactcctccgctacgcaaaaaatcaaactagaaaaagggaagctttataaaataaacatcacttatcagccagaatcttcttccgctaacgaatttggcttacagcttaactggattactccacaaggaacggaagaaatcattccagagggaaatctactgcttcctgacataaaaaatcaaccagagaatgaatctagcagaaaaaaaagaagtatttcaacagcttctgatggcggagttgaagatagtgacggggacggcatccctgattccctagaaatcgaaggatacaccttggatgtcaagaataaaaaactcaccctaatgccttggattgaaaaagttcatggaaaaaaacgcacgaaatctggagcaccgttaacaaaatatacatcttcacctatgaaatggagcacggcttctgacccatatagcgatttcgccaaagtatcaggaatgattgataaaaaggtaaaagtgaaacatccgttgatcgctgcgtatcctaatttacaggttcatatggacaaatttattatttcaaaaaatagaaatgaaacgctagaaaatggtgtgaatacaagtagttcgatcagtggaagtacttccacaagcaatactcattcaacagaagcttctgttggggcgcaagtccatgcttccttatttaactttggcggaagtgtatccactaattttagcgatagtaattcacagaccgtaaccattgatcgttcgagttctgagagtttagggaaaaactggtccaagtctttaggtctaaacgcaggagaggctgcctattttaatgcgaacatccgctatgttaataatggtacggcacctatttatgaagcagcacctactacttcactagtactagggaaaaacgataccattgcaacgataaaagcaaaagagaaccagctagcaaacgtagtgttaccagaccgtttttatccaagtaaagatcaagcagctatttctctacaaaccaaagacgatttcggttctagccctatcacaatcaataaggatcagcttgatattctggagcagacacaacaaatgcgcttggaaacagatcaggtttccggttatgtaggtgtaattgatcctaaaacaaaattagttgaggtagataaagataagcagtggagtcatattatccctcaaattgaggaaactactgctcgactaatcttaaaaacaccagacaattcagagctggaaagacgagtagctgctgttgatcctgatgacattatcgagcaaacgaagccagatgttacattaggagaagcgctccaattagcttttggttttgaggacaaggaaggaaaattatattacaacaatacgagtatagatgattttagattggtgtttgatgaagaaactgctgaaaatatagaaaaacaattagaagatctgaaaacaaaaaatatctatgatgtccaactgcatgctcgaatgaatatactaatttcaccgaagaaggatgagcctggtgtaagtgaagggttatctagctgggaaatagatggggaagacaattactataaatatgatgtgctgcaaactggctggcaaacgataaatgggaaaaagtattattttaatgaaaatggcactttagtacccaacaaagtaattgaggatggaacctatcaaataaatacagcattaaagaatacaagtctagttgattggaatagaagcgataataatatcacagtgtgggaaacgaacgatggaagtaatcaaaaatggaaattgaaatatgatgactctcaacaagcctatgtgattcgaagcttagaaaataacgataaaattatggcttggaatgcttatcaggattccactaatgtatttgctgcaacgtttgaagggaaacccgaacatttttggattcctgaattgctaggtaatgatttctatatcttaaaaaacaagaaagatccgactaaagtgttggatgtagatggttcaggcacttcaaacgggtccaatattcaggtacgtgattacaaaggcactgataatcaaaaatggaaattagaacaagtggaagcaaactag

SEQ ID NO: 392 - DNA, 2463 bp, Brevibacillus Sp.
atgaagttacctaaaatgtataaatgtttgatggcaaccgcccttcttggtcaaattgcgacctatccagaaatatcacacgcggcttcaaacgaaaaggaagtcgtaactacacaagatgctaattttaaaggcttattaggctactatttcaatgataaggatttaaagcagactgctatgatctcgaattctgagacaggcgatttatccattgacagcgatcaactagatgaaatgttgcctgaggaattgcaacagtttcaatctgccatgtggaaaggatttattaaggtagaaaaatcaggtgaatatactttctccacgtctgataatgaccacaccacgctatggatagatgatcaacaagtcatcgatcactcctccgctacgcaaaaaatcgaactagaaaaagggaagctttataaagtaaaaattacttatcagccagaatcctcttccactgacgaatttggcttacagcttaactggattactccacaaggaacggaagaaatcattccagagggaaatctactgcttcctgacataaaaaatcaaccagagaatgaatctggcagaaaaaaaagaagtatttcagcttctgatgacggagttgaagatagtgacggtgacggcatccctgattccttagaagttgagggatacaccttggatgtcaagaataaaaaacttatcctgatgccttggattgaaaaagttcatggaaaaaaacgcacaaaatctggtgaaccgttaacgaaatataaatcatctcctttgaaatggagtaccgcttctgatccgtatagcgattttgccaaagtatcaggaatgattgataaaaaggtacaagtgagaaatccattgcttgctgcgtatcctaatttacaagttcatatggaaaaatttattatctcgaaaaatagaaatgaaacgcttgaaaatggcgggaatacaagtagttcaatcagtggaagtacatctacaagcaatactaattcaatagaagcttctattgggtcagaagtcaatgcttccctgtttaattttggtgcaagtatatctactaatttgagcaccagtaattcacagacagtaaccattgatcgttcaagctctgagagtttgggaagaaactggtccaagtccttaggcctaaatgcaggagaggctgcctattttaatgcgaacattcgctatgttaataatggtacggcacctatttatgaagcagcacctactacctcactcgtgctaggagataacgacaccatttcaacaattaaagcaaaagaaaaccaactagcaaatgtagtgttaccggaccgtttttatccaagtaaagatcaagcagctatttctctacaaaccaaagacgatttcggttctagcccgattacaatcaataaagatcagcttgataaactagagcaaacacagcaaatgcgcttggaaacagatcaggtttccggttatgtaggagtaattgatccgaaaacaaaattagtgtcagttgataaagataagcaatggagtcatattatccctcaaattgaggaaacgactgctcgattgatcttaaaaacagatgattcagagacagaaagacgagtagctgctgttgatcctgacgactacaccgaacaaacgaagccagatattacattaggagaagcgctccaattagcttttggttttgaggacaaggaaggaaccttatattacaacaataaaagtatagatgagtttaaattggtatttgatgaagaaactgctgaaaatatcgaaaaacaattagaagatatggaatcagaaaatatctatgacgtccaactgcatgctcgaatgaatatcctaatcaagccgaataatgatgaacctactgatgaagttgaggtatctggttgggaaacattagacggagaagagtattactatagatttggcgtgatgcaaactggttggcaaacgatagatgggaaaagatattattttaatgaaaatggtgcattagtacccaacagagtaattgaggatggaacctatcaaattaaaacagcattaaagaatacaagtctagttgattggaatagaaacgataataatattacagtgtgggaaacgaacgatggaagtaatcaaaaatggaagttagaatatgatgactctcatcaagcctatgtgattcgaagcttagaaaataacgataaaattatggcttggaatgcttatcaggattccactaatgtatttgctacaccgtttgaagggaaacccgaacatttttggattcctgaatggattgataatgacttctatatcttaaaaaacaagaaagacccgactaaagtgctggatgtagatggttcaagcacttcaaacgggtccaacattcaggtaagtgattacaaaggcactgataatcaaaagtgggaagtaaaacaagtgaaagaaagttaa

SEQ ID NO: 393 - DNA, 2463 bp, Brevibacillus Sp.
atgaagttacctaacatgtataaatgtttgatggcaactgcccttctcggtcaatttgcaacctatccagaaatatcacatgcggcttcacacgaaaaggaagtagtaactacacaagatgctaattttaaaggcttaattggctactattttaatgataaagaattaaaacagactgctctgatctcgaattcagagacaggcgatttatccattgacagcgatcaactagatgacatgttgcctgaggaattgcaacagtttcaatctgccatgtggaaaggatttattaaggtagaaaaatcaggtgaatatacgttctccacgtctgataatgaccacaccatgctatggatagatgatcaacaagtcatcgatcactcctctgctacgcaaaaaatcgaattaaaaaaagggaagctttataaagtaaaaattacttatcagccagaatccgcttccgctaacgaatttggcttacagcttaactggattactccacaaggaagggaagaaatcattccagagggaaatctactgcttcctgacataaagaatcaaccagagaatgaatctagcagaaaaaaaagaagtatttcagcttctgatgacggagttgaagatagtgatggtgacggcatccctgattccttagaagttgagggatacaccttggatgttaagaataaaaaacttatcctgatgccttggattgaaaaagttcatggaaaaaaacgcacgaaatctggtgctccactaacgaaatataaatcatctccattgaaatggagtaccgcttccgatccgtatagtgattttgccaaagtatcaggaatgattgataaacaggtacaagtgagaaatccattgcttgctgcatatcctaatttacaagttcatatggagaaatttattatctcgaaaaatagacatgaaacgttagaaaatggcgggaatacaagtagttcaatcagtggaagtacttccacaagcaatactaattcagtagaggtttctgttggagctgaagtccacgcttccctctttaattttggtggaagtgtatctactaatttgagcgccagcaattcacagaccgtaaccattgatcgttcaagctctgagagtttagggaaaaactggtccaagtccttaggcctaaacgcaggagaggctgcctattttaatgcgaatatccgctatgtgaatagtggtacagcacctatttatgatgcagcacctactacctcactcgtgctaggagataacgacaccatttcaacaattaaagcaaaagaaaaccaactagcaaatgtagtgttaccgaaccgtttttatccaaataaagaacaagcagctatttctctacaaaccaaagacgatttcggttctagccctattacaatcaataaagatcagcttgataaactagagcaaacacagcaaatgcgcttgcaaacaaatcaggtttccggttatgtaggagtaattgatcctaaaacaaaattagtatcagttgataaagagaagcaatggagtcatattatccctcaaattgaggaaactactgctcgattgatcttaaaaacagatgattcagagacagaaagacgagtagctgctgttgatcctgacgactacaccgaacaaacgaagccagatgttacattaggagaagcgctccaattagcttttggttttgaggacaaggatggaaccttatattacgacaataaaagtatagatgagtttaaattggtatttgatgaagaaactgctgaaaatatagaaaaacaattagaagatatggaatcagaaaatatctatgacgtccaactgcatgctcgaatgaatattctaatcaagccgaataatgatgaacctattgatgaagttgaggtatctggttgggaagaatttgatggagaaaaatattacaatagatttggcgtgatgcaaactggttggcaaatgatagatgggaaaagatattattttaatgaaaatggtgcattagtacccaacagagtaattgaggatggaacctatcaaattaaaacagcattaaagaatacaagtctagttgattggaataaaagcgataataatatcacagtgtgggaaaagaacaatgaggataatcaaaaatggaagttagaatatgatgactctcatcaagcctatgtgattcgcagcgtagaaaataacgataaaattatggcttggaatgcttatcaggattccactaatgtatttgctacagcgtttgaagggaaacccgaacatttttggattcctgaatggattgataatgacttctatatcttaaaaaataagaaagaccttactaaagtgctagatgtagatggttcaaacacttcagacgggtccaacattcaggtacgagattacaaaggcactgataatcaaaagtgggaagtaaaactagtgaaagaaagttaa

SEQ ID NO: 394 - DNA, 2463 bp, Brevibacillus Sp.
atgaagttacctaacatgtataaatgtttgatggcaactgcccttctcggtcaatttgcaacctatccagaaatatcacatgcggcttcacacgaaaaggaagtagtaactacacaagatgctaattttaaaggcttaattggctactattttaatgataaagaattaaaacagactgctctgatctcgaattcagagacaggcgatttatccattgacagcgatcaactggatgacatgttgcctgaggaattgcaacagtttcaatctgccatgtggaaaggatttattaaggtagaaaaatcaggtgaatatacgttctccacgtctgataatgaccacaccatgctatggatagatgatcaacaagtcatcgatcactcctccgctacgcaaaaaatcgaattagagaaagggaagctttataaagtaaaaatcacttatcagccagaatccgcttccgataacgaatttggcttacagcttaactggattactccacaaggaagggaagaaatcattccagagggaaatctactgcttcctgacataaaaaatcaaccagagaatgaatctagcagaaaaaaaagaagtatttctgcttctgatgacggagttgaagatagtgacggtgacggcatccctgattccttagaagttgagggatacaccttggatgttaagaataaaaaacttatcctgatgccttggattgaaaaagttcatggaaaaaaacgcacgaaatctggtgctccactaacgaaatataaatcatctccattgaaatggagtaccgcttccgatccgtatagtgattttgccaaagtatcaggaatgattgataaacaggtacaagtgagaaatccattgcttgctgcatatcctaatttacaagttcatatggagaaatttattatctcgaaaaatagacatgaaacgttagaaaatggcgggaatacaagtagttcaatcagtggaagtacttccacaagcaatactaattcagtagaggtttctgttggagctgaagtcaatgcttccctgtttaattttggtgcaagtatatctactaatttgagcaccagtaattcacagaccgtaaccattgatcgttcgagttctgagagtttagggaaaaactggtccaagtccttaggcctaaacgcaggagaggctgcctattttaatgcaaacatccgctatgtgaatagtggtacagcacctatttatgatgcagcacctactacctcactcgtgctaggagataacgacaccatttcaacaattaaagcaaaagaaaaccaactagcaaatgtagtgttaccgaaccgtttttatccaaataaagaacaagcagctatttctctacaaaccaaagacgatttcggttctagccctattacaatcaataaagatcagcttgataaactagagcaaacacagcaaatgcgcttgcaaacaaatcaggtttccggttatgtaggagtaattgatcctaaaacaaaattagtatcagttgataaagagaagcaatggagtcatattatccctcaaattgaggaaactactgctcgattgatcttaaaaacagatgattcagagacagaaagacgagtagctgctgttgatcctgacgactacaccgaacaaacgaagccagatgttacattaggagaagcgctccaattagcttttggttttgaggacaaggatggaaccttatattacgacaataaaagtatagatgagtttaaattagtatttgatgaagaaactgctgaaaatatagaaaaacaattagaagatatggaatcagaaaatatctatgacgtccaactgcatgctcgaatgaatattctaatcaagccgaataatgatgaacctattgatgaagttgaggtatctggttgggaagaatttgatggagaaaaatattacaatagatttggcgtgatgcaaactggttggcaaatgatagatgggaaaagatattattttaatgaaaatggtgcattagtacccaacagagtacttgaggatggaacctatcaaattaaaacagcattaaagaatacaagtctagttgattggaataaaagcgataataatatcacagtgtgggaaaagaacaatgaggataatcaaaaatggaagttagaatatgatgactctcatcaagcctatgtgattcgcagcgtagaaaataacgataaaattatggcttggaatgcttatcaggattccactaatgtatttgctacaccgtttgaagggaaacccgaacatttttggattcctgaatggattgataatgacttctatatcttaaaaaataagaaagaccttactaaagtgctagatgtagatggttcaaacacttcagacgggtccaacattcaggtacgagattacaaaggcactgataatcaaaagtgggaagtaaaactagtgaaagaaagttaa

SEQ ID NO: 395 - DNA, 1962 bp, Bacillus Sp.
atgtttaaagaaaaaacaaatagaagactaaaaaagattgttattattactgcggcttgcaccatgatgtcaatgtatggagcaccaatttctagtacagaggcagcaatccgatctcatgctccatcagtttatgtaacaccacaaaatactgctgcttcagatattattagcatagactggtcaccggtccaaacagcaccttatacgtattgggctgtgcataactggaatcaggggggggagggtggtggttatgctggcttccaacaacaaagtggctttgatcaaaccggtaaacgtactcttcattttgcgctttgggatccaatagcatcaaaccaagcaataaaagctgaatatttatcgccgacttcagaagccggtagatttggtggagaaggaacaggtctgaaggtccaaacaacttataattggaaagatagtgaatggtatcgaatgactctacgttcttggcaagaagatggccatacaaagtttggccaatggataaaagataataaattaaatcaatggaagttagttgctattatggatcatccagttgcaaatgttgcatttaactatggtctatcgatgtttcaagaggactgggctggtaatggacaagatgtaagagaagcacgccttaaaaatggatacagcagaaaagtttcagatcaacaatggaattcttggaataatcagcgtatctctgggcaacatgatacgtcctatcaatacgatggaggagcaacttcagaatatctctgggttaaggcaggaggaaatactcaatcaactattggtactggaaaaagtttcaatataaatcagcctagtcaaccagaaatgggaattttagattttgatattcaaaatattcgctttgaagatgagaaattaaatgtttcttggaaattgaaagaacaaagtactccacaatttaaagggaaaattgaaatctatgataatgaaaagttaatgggacaacctttgaaagtaattgataatattaagtcttacgaaactgagataagtcaaactatgcaattacctcaaacggcttttgctaaaattacattaacagacatatttgatcgaactgtagagaaaaaagtaggaattataaatggaaattctgatattttagtagggaaccaatttgcatggtccctaaaaggatatagtgatcgagaaattgcaaaagtagattataataaggcggcagaagagttgaaaatcaaattagaagctggtgtaccgcattcttacttcaatagcacatatgcaagtattaaggtccaaaactcatctggtagcgtattatacaataaggaaatcgtggggaatagacaacaaaataccgaaagccaaactgtgtctgtaaaagtgggggattacattgaattaactcatatagaaggagacgcagtaaaggaaaagacacgcgcaacattaacgaatcttgaaaataacaaaaatgagactattggaaagacagcaaggtatctggttactaaagagggattagagaaagttgaaaaaatgccagagacaacaattctagatggaaaacaatttgcatggtcattaaaaggatatagtgatcgagaaattgcaaaagtagattataataaaacagcagaagagctgaaaatcaaattagaagctggcgtaccgcattcttactttaatagtacatatgcaagtattaaagtccaaggctcatccggtaacgttatgtacaataaggaaatcatgggaaatagacaacaaaatgctgaaacccaaacagtacctataaaagtgggagattatatagaatttactcatatagaaggggaagcagcaaaggaaaaaacgcgagcgactttaactaaccttgagaacagaaaacaggaatatataggtaagaaaagaacatatcaggtcacatccactggattattaagacaatag

SEQ ID NO: 396 - DNA, 1962 bp, Bacillus Sp.
atgtttaaagaacaaaccaatggaagactaaaaaagattgttataattactgcggcttgcaccatgatgtcaatgtatggagcaccaatttctagtacaaaggcagcaatccgatcccatgctccatcagtttatgtaacaccacaaaatactgctgcttcagatatcattagcatagactggtcaccagttcaaacggctccttatacgtattgggctgtgcataattggaatcaggggggagagggtggtggttatgctggcttccaacaacaaagtggttttgatcaaaacggtaaacgtacccttcactttgcgctttgggatccaatagcatcaaaccaagcaataaaagctgaatatttatcgccgactgcagaagctagtagatttggtggggaaggaacaggtctgaaggtacaaacaacttataattggaaagatagtgaatggtatcgaatgactctacgttcttggcaagaagatggccatacgaaatttggccagtggataaaagataataaattaaatcaatggaagttagttgctattatggatcatccagttgcgaatgttgcatttaactatggtctatcgatgttccaagaggattgggctggtaatggacaagatgtaagagaagcacgcctaaaaaatggatacagtagaaaagtttcagataaacaatggaattcttggaataatcagcgtatcagtgggcaacatgatacatcttatcaatacgatggaggagcaacttcagaatatatatgggttaaggcaggaggaaatactcaatcaacgattggtactggaaaaatttttaatataaatcagcctagtcaaccagaaatgggaaatttagattatgatattcaaaatattagctttgaagctgaaaaattaaatgtgtcttggaaattgaaagaacaaagtaccccacagtttaaagggaaaattgaaatctatgacaatgaaaagttaatgggacaacctttgaaagtaattgataatattaagtcctaccaaactgaggtaagtcaaactatgcaattgcctcaaacggcttttgctaaaattacattaacagacatatttgatcgaactgtagagaaaaaagtaggaattacaaatggaaattctgatattttagtagggaaccaatttgcatggtccctaaagggatatagtgatcgagaaattgcaaaagtagattataataaagcggcagaagagctgaaaatcaaattagaagctggtgtaccgcattcttacttcaatagcacatatgcaagtattaaggtccaaaactcatctggtagcgtattatacaataaggaaatcgtggggaatagacaacaaaatactgaaacccaaactgtgtctgtaaaagtaggggattacattgaattaactcatatagaaggagacgcagtaaaggaaaagacacgcgcaacattaacgaatcttgaaaataacaaaaatgagactattggaaagacagcaaggtatctggttacaaaagagggattaaagaaagttgaaaaaatgccagagacaacaattctagatggaaaccaatttgcatggtcattaaaaggatatagtgatcgagaaattgcaaaagtagattataataaaacagcagaagagctgaaaatcaaattagaagctggcataccgcattcttactttaatagtacatatgcaagtattaaggtccaaagctcatctagtagcgtattatacaataaggaaatcataggaaatagacaacaaaatgctgaaacccaaacagtacctctaaaagtgggagattatatagaatttactcatatagaaggggaagcagcaaaggaaaaaacgcgagcgactttaacaaaccttgagaatggaaagcaggaatatataggtaagaaaagaacatatcaggttacatccacaggattaataagaaaatag

SEQ ID NO: 397 - DNA, 1962 bp, Bacillus Sp.
atgtttaaagtaaaaacaaatggaagaatcaaaaagattgttatgatttctgcggcttgtaccatgatgtcaatgtatggagcaccaatttctagtacagaggcagcaatccgatcgcatgctccatctgtttatgtaacaccacaaaatactgctgcttcagatattattagcatagactggtcaccaatccaaacggcaccttatacatattgggctgtacataactggaatcagggaggagagggtggcggttatgctggcttccaacaacaaagcggtttcgatcaaaccggtaaacgtacccttcactttgcactttgggatccaatagcatcaaaccaagcgataaaagctgaatatttatcgccgacttcagaagccagtagatttggtggagaaggaacaggtctgaaggtacaaacaacttataattggaaagatagtgaatggtatcgaatgactctacgttcttggcaagaagatggccatacaaagtttggccagtggataaaagataataaattaaatcaatggaagttagttgctattatggatcatccagttgcgaatgttgcattcaactatggtctatcgatgtttcaagaggactgggctggtaatggacaagatgtaagagaagcacgtcttaaaaatggatatagcagaaaagtttcagataaacaatggaattcttggaataatcagcgtatttctgggcaacatgatacttcttatcaatacgatggaggagcaacttcagaatatgtatgggttaaggctggaggaaatacgcaatcaacgattggtactggaaagacttttaatataaatcagcctagtcaaccagaaatgggaaatttggattttgatattcaaaatattcgttttgaaaatgaaaaattaaatgtgtcttggaaattgaaagaacaaagtactccccagtttaaagggaaaattgaaatttatgacaatgaaaagttaacgggacaagctttgaaagtaatcgacaatattaaatcctatcaaactgaggtaagtcaaactatgcaattgcctcaaacagcttatgctaaaattacattaacagatatatttgatcgaactgtagagaaaaaagtaggaattacaaatggaaattctgatattttagtagggaatcaatttgcatggtccctaaaaggatatagtgatcgagaaattgcaaaagtggattataataaagcggcagaagagctgaaaatcaaattagaagctggtgtaccgcattcttatttcaatagcacatatgcaagtattaaagttcagaactcatctggtagcgttatgtacaataaggaaatcatgggaaatagacaacaaaatgctgaaatccaaacagtacctgtaaaagtaggagattatttagaattcactcatatagaaggagacgcagtaaaggaaaagacacgcgcaacattaacgaatcttgaaaataacaaaaatgagacttttggaaagtcagcaaggtatcaggttacaaaagagggattaaagaaagtagaaaaaatgccagagacaacaattctagatggaaaacaatttgcatggtcattaaaaggatatagtgatcgagaaattgcaaaagtagattataataaaacagcagaagagctgaaaatcaaattagaagctggtgtaccgcattcttatttcaatagcacatatgcaagtattaaagtccagaactcatctggtagcgttatgtacaataaggaaatcatgggaaatagacaacaaaatgctgaaacccaaatagtacctgtaaaagagggagattatatagaatttactcatatagaaggggaagcagcaaaggaaaaaacacgagcgactttaactaaccttgagaatgaaaaacaggaatatataggaaagaaaagaacatatcgggttacatctacaggattaataagacaataa

SEQ ID NO: 398 - DNA, 1962 bp, Bacillus Sp.
atgtttaaagtaaaaacaaggggaaaaataaaagaaattgttatggtttcaacggcttgtaccatgttgtcaatgtatggagcaccaatttctagtacagaggcagcaacccgatctcatgccccatcagtttatgtaacaccacagaatactgctgcttcagatattattagcatagactggtcaccagtccaaacagcaccttatacatattgggctgtgcataactggaatcagggaggagaaggtggtggttatgcgggcttccaacaacaaagtggttttgatcaattcggtaaacgtacccttcactttgcgctttgggatccaatagcatcaaaccaagcaataaaagctgaatatttatcgccgacttcagaagccagtagatttggtggagaaggaacaggtctaaaggtacaaacaacttataattggaaagatagtgaatggtatcgaatgactctacgttcttggcaagaagatggccatacaaagtttggccagtggataaaagataataaattaaatcaatggaagttagttgctattatggatcatccagttgcaaatgtggcatttaactatggtttatcgatgtttcaagaggactgggctggtaatggacaagatgtaagagaagcacgtcttaaaaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacctttaatataaatcagcctagtcaaccagaaatgggaaatttagattttgatattcaaaatactcgctttgaagatggaaaattaaatgtttcatggaaattgaaagaacaaagtactccacagtttaaagggaaaattgaaatctatgacaatgaaaagttaatgggacaacctttgaaagtaatcgataatattaagtcttacaaaactgaggtaagtcaaactatgcaattgcctcaaacggcttttgctaaaattacattaacagacatatttgatcgaactgtagagaaaaaagtagaaattacaaatggaaattctgatattttagtagggaaccaatttgcatggtccctaaaaggatatagtgatcgagaaattgcaaaagtagattataataaaacagcagaagagctgaaaatcaaattagaagctggtgtgccgcattcttatttcaatagcacatatgcaagtattaaagtccagaactcatctggtagcgttttgtacaataaggaaattatgggaaatagacaacaaaatgctgaaacccaaacagtacctgtaaaagtaggagattatttagaattcactcatatagaaggggaagcagcaaaggaaaaaacacgcgcaacattaacgaatcttgaaaataataaaaatgagactattggaaagtcagcaaggtatgaggttacaaaagagggattaaagaaagtagaaaaaatgccagagacaacaattctagatggaaaacaatttgcatggtccctaaaaggatatagtgatcgagaaattgcaaaagtagattataataaaacagcagaagagctgaaaatcaaattagaagctggtgtgccgcattcttatttcaatagcacatatgcaagtattaaagtccagaattcatctggtagcgttttgtacaataaggaaattatgggaaatagacaacaaaatgctgaaacccaaacagtacctgtaaaagagggagattatatagaatttactcatatagaaggggaagtggcgaaggaaaaaacacgagcgactttaactaaccttgagaatggaaaacaggaatatataggaaagaaaagaacatatcgggttacatctacaggtttaatcagacaatag

SEQ ID NO: 399 - DNA, 1962 bp, Bacillus Sp.
atgtttaaagtaaaaacaaggggaaaaataaaaagaattgttatggtttcaacggcttgtaccatgttgtcaatgtatggagcaccaatttctagtacagaggcagcaacccgatcgcatgccccatcagtttatgtaacaccacaaaatactgctgcttcagatattattagtatagactggtcaccagtccaaacagcaccttatacgtattgggctgtgcataactggaatcagggaggggagggtggtggttatgcgggtttccaacaacaaagtggttttgatcaattcggtaaacgtacccttcactttgcactttgggatccaatagcatcaaaccaagcaataaaagctgaatatttatcgccgacttcagaagccagcagatttggtggagaaggaacaggtctgaaggtacaaacaacttataattggaaagatagtgaatggtatagaatgactctacgctcttggcaagaagatggccatacaaagtttggccagtggataaaagataatacattaaatcaatggaagttagttgttattatggatcatccagttacgaatgttgcatttaactatggtttatcgatgtttcaagaggactgggctggtaatggacaagatgtaagagaagcacgtcttaagaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacgtttaatataaatcagcctagtcaaccagaaatgggaaatttagattttgatatccaaaatactcgctttgaagctggaaaattaaatgtttcatggaaattgaaagaacaaagtactccacagtttaaagggaaaattgaaatctatgacaatgaaaagttagcgggacaacctttaaaagtaattgataatattaagtcctaccaaactgaggtaagtcaaactatgcaattgcctcaaacagcttttgctaaaattacattaacagatatatttgatcgaactgtagagaaaaaagtaggaattacaaatggaaattctgatattttagtagggaatcgatttgcatggtccctaaaaggaattagtgattttgagtttgcaaaaatcaatttcaataagtcgacagaagaaatgcaaattgacttaaaagcaggcgtaccgcatcattattttaatgaaacgtatgcgagtattaaagtacaaaatgcatcaggaaaagtagtatataataatgacatttatggaaacaaacaacaaaatgctgaaacccaaacagtgcccgtaaaagtgggagattacattgaattaactcatatagaaggagacgctgtaaaggaaaaaaaacgcgcaacattaatgaatcttgaaaataacaaaaatgaaactattggaaagacagcaagataccaggttacaaaagagggcttaaagaaagtagaaaaaatgccagagacaacaattctagatggaaaacaatttgcatggtcattaaaaggatatagtgatcgagaaattgcaaaagtagattataatcaaacagcagaagagctgaaaatcaaattagaagctggcgtaccgcattcttacttcaatagtacatatgcaagtattaaagtccagaactcgtctggtagcgttatgtacaataaagaaatcatgggaaatagacaacaaaatgctgaaacccaaacagtacctataaaagtgggagattatatagaatttactcatatagaaggggatgcagctaaggaaaaaacaagagcgactttaactaaccttgagaatggaaaacaggaatatataggaaagaaaagaacatatcaggttacatctacaggattaataagacaataa

SEQ ID NO: 400 - DNA, 1962 bp, Bacillus Sp.
atgtttaaagtaaaaacaaggggaaaaataaaaagaattgttatggtttcaacggcttgtaccatgttgtcaatgtatggagcaccaatttctagtacagaggcagcaacccgatcgcatgccccatcagtttatgtaacaccacaaaatactgctgcttcagatattattagtatagactggtcaccagtccaaacagcaccttatacgtattgggctgtgcataactggaatcagggaggggagggtggtggttatgcgggtttccaacaacaaagtggttttgatcaattcggtaaacgtacccttcactttgcactttgggatccaatagcatcaaaccaagcaataaaagctgaatatttatcgccgacttcagaagccagcagatttggtggagaaggaacaggtctgaaggtacaaacaacttataattggaaagatagtgaatggtatagaatgactctacgctcttggcaagaagatggccatacaaagtttggccagtggataaaagataatacattaaatcaatggaagttagttgttattatggatcatccagttacgaatgttgcatttaactatggtttatcgatgtttcaagaggactgggctggtaatggacaagatgtaagagaagcacgtcttaagaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacgtttaatataaatcagcctagtcaaccagaaatgggaaatttagattttgatatccaaaatactcgctttgaagctggaaaattaaatgtttcatggaaattgaaagaacaaagtactccacagtttaaagggaaaattgaaatctatgacaatgaaaagttagcgggacaacctttaaaagtaattgataatattaagtcctaccaaactgaggtaagtcaaactatgcaattgcctcaaacagcttttgctaaaattacattaacagatatatttgatcgaactgtagagaaaaaagtaggaattacaaatggaaattctgatattttagtagggaatcgatttgcatggtccctaaaaggaattagtgattttgagtttgcaaaaatcaatttcaataagtcgacagaagaaatgcaaattgacttaaaagcaggcgtaccgcatcattattttaatgaaacgtatgcgagtattaaagtacaaaatgcattaggaaaagtagtgtataataatgacatttatggaagcaaacaacaaaatgctgaaacccaaacagtgcccgtaaaagtgggagattacattgaattaactcatatagaaggagacgctgtaaaggaaaaaaaacgcgcaacattaatgaatcttgaaaataacaaaaatgaaactattggaaagacagcaagataccaggttacaaaagagggcttaaagaaagtagaaaaaatgccagagacaacaattctagatggaaaacaatttgcatggtcattaaaaggatatagtgatcgagaaattgcaaaagtagattataatcaaacagcagaagagctgaaaatcaaattagaagctggcgtaccgcattcttacttcaatagtacatatgcaagtattaaagtccagaactcgtctggtagcgttatgtacaataaagaaatcatgggaaatggacaacaaaatgctgaaacccaaacagtacctataaaagtgggagattatatagaatttactcatatagaaggggatgcagctaaggaaaaaacaagagcgactttaactaaccttgagaatggaaaacaggaatatataggaaagaaaagaacatatcaggttacatctacaggattaataagacaataa

SEQ ID NO: 401 - DNA, 1890 bp, Bacillus Sp.
atgtatggagcaccaatttctagtacagaggcagcaacccgatcgcatgccccatcagtttatgtaacaccacaaaatactgctgcttcagatattattagtatagactggtcaccagtccaaacagcaccttatacgtattgggctgtgcataactggaatcagggaggggagggtggtggttatgcgggtttccaacaacaaagtggttttgatcaattcggtaaacgtacccttcactttgcactttgggatccaatagcatcaaaccaagcaataaaagctgaatatttatcgccgacttcagaagccagcagatttggtggagaaggaacaggtctgaaggtacaaacaacttataattggaaagatagtgaatggtatagaatgactctacgctcttggcaagaagatggccatacaaagtttggccagtggataaaagataatacattaaatcaatggaagttagttgttattatggatcatccagttacgaatgttgcatttaactatggtttatcgatgtttcaagaggactgggctggtaatggacaagatgtaagagaagcacgtcttaagaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacgtttaatataaatcagcctagtcaaccagaaatgggaaatttagattttgatatccaaaatactcgctttgaagctggaaaattaaatgtttcatggaaattgaaagaacaaagtactccacagtttaaagggaaaattgaaatctatgacaatgaaaagttagcgggacaacctttaaaagtaattgataatattaagtcctaccaaactgaggtaagtcaaactatgcaattgcctcaaacagcttttgctaaaattacattaacagatatatttgatcgaactgtagagaaaaaagtaggaattacaaatggaaattctgatattttagtagggaatcgatttgcatggtccctaaaaggaattagtgattttgagtttgcaaaaatcaatttcaataagtcgacagaagaaatgcaaattgacttaaaagcaggcgtaccgcatcattattttaatgaaacgtatgcgagtattaaagtacaaaatgcatcaggaaaagtagtatataataatgacatttatggaaacaaacaacaaaatgctgaaacccaaacagtgcccgtaaaagtgggagattacattgaattaactcatatagaaggagacgctgtaaaggaaaaaaaacgcgcaacattaatgaatcttgaaaataacaaaaatgaaactattggaaagacagcaagataccaggttacaaaagagggcttaaagaaagtagaaaaaatgccagagacaacaattctagatggaaaacaatttgcatggtcattaaaaggatatagtgatcgagaaattgcaaaagtagattataatcaaacagcagaagagctgaaaatcaaattagaagctggcgtaccgcattcttacttcaatagtacatatgcaagtattaaagtccagaactcgtctggtagcgttatgtacaataaagaaatcatgggaaatagacaacaaaatgctgaaacccaaacagtacctataaaagtgggagattatatagaatttactcatatagaaggggatgcagctaaggaaaaaacaagagcgactttaactaaccttgagaatggaaaacaggaatatataggaaagaaaagaacatatcaggttacatctacaggattaataagacaataa

SEQ ID NO: 402 - DNA, 1842 bp, Bacillus Sp.
atgtttaaagtaaaaacaaggggaaaaataaaaagaattgttatggtttcaacggcttgtaccatgttgtcaatgtatggagcaccaatttctagtacagaggcagcaacccgatcgcatgccccatcagtttatgtaacaccacaaaatactgctgcttcagatattattagtatagactggtcaccagtccaaacagcaccttatacgtattgggctgtgcataactggaatcagggaggggagggtggtggttatgcgggattccaacaacaaagtggttttgatcaattcggtaaacgtacccttcactttgcactttgggatccaatagcatcaaaccaagcaataaaagctgaatatttatcgccgacttcagaagccagcagatttggtggagaaggaacaggtctgaaggtacaaacaacttataattggaaagatagtgaatggtatagaatgactctacgctcttggcaagaagatggccatacaaagtttggccagtggataaaagataatacattaaatcaatggaagttagttgctattatggatcatccagttgcaaatgttgcatttaactatggtttatcgatgtttcaagaggactgggctggtaatggacaagatgtaagagaagcacgtcttaaaaatggatacagcagaaaagtttcagataaacaatggaattcttggaataatcagcgtatctctgggcaacatgatacgtcctatcaatacgatggagaagcaacttcagaatatctatgggttagggcaggaggaaatactcaatcaactattggtactggaaaaacttttaatataaatcagcctagtcaaccagaaatgggaaatttagattttgatatccaaaatactcgctttgaagctggaaaattaaatgtatcatggaaattgaaagaacaaagtactccacagtttaaagggaaaattgaaatctatgacaatgaaaagttaatgggacaacctttaaaagtaattgataatattaagtcctaccaaactgaggtaagtcaaactatgcaattgccccaaacagcttttgctaaaattacattaacagatatatttgatcgaactgtagagaaaaaagtaggaattacaaatggaaattctgatattttagtagggaatcgatttgcatggtccctaaaaggaattagtgattttgagtttgcaaaaatcaatttcaataagtcgacagaagaaatgcaaattgacttaaaagcaggcgtaccgcatcattattttaatgaaacgtatgcgagtattaaagtacaaaatgcatcaggaaaagtagtatataataatgacttttatggaaacaaacaacaaaatgctgaatcgcaaaaagttccagtcaaagtaggagattatattgagttaacacatctagaaggtgtgcatagagcgaatttcacaaatttagacaacagtaaacaagaaagctttggaaaaaaagcaatgtatgaagtcacaaaagaaagcttgaagaaagtagaaaaaatgccagagacaacaattctagatggaaaacaatttgcatggtcattaaaaggatatagtgatcgagaaattgcaaaagtagattataatcaaacagcagaagagctgaaaatcaaattagaagctggcgtaccgcattcttacttcaatagtacatatgcaagtattaaagtccagaactcgtctggtagcgttatgtacaataaggaaatcatgggaaatagacaacaaaatgctgaaacccaaacagtgcccgtaaaagtgggagattatatagaatttactcatatagaaggggaagcagcatag

SEQ ID NO: 403 - DNA, 2364 bp, Bacillus Sp.
atgtttaaagtaaaaacaaatggaagaatcaaaaagattgttatgatttctgcggcttgtaccatgatgtcaatgtatggagcaccaatttctagtacagaggcagcaatccgatcgcatgctccatctgtttatgtaacaccacaaaatactgctgcttcagatattattagcatagactggtcaccaatccaaacggcaccttatacatattgggctgtacataactggaatcagggaggagagggtggcggttatgctggcttccaacaacaaagcggttttgatcaagccggtaaacgtacccttcactttgcactttgggatccaatagcatcaaaccaagcaattaaagctgaatatttatcgccgacttcagaagccagtagatttggtggagaaggaacgggtttgaaggtacaaacaacctataattggaaagatagtgaatggtatcgaatgacactacgttcttggcaagaagatggtcatacaaagtttggccagtggataaaagataataaattaaatcaatggaagttagttgctattatggatcatccagttgcgaatgttccatttaactatggtttatcgatgtttcaagaggactgggctggtaatggacaagatgtaagagaagcacgccttaaaaatggctatagcagaaaagtttcagataaacaatggaattcttggaataatcagcgtatctctgggcaacatgatacctcttatcaatacgatggaggagcaacttcagaatatctatgggttaaggcgggaggaaatactcaatcaactattggtactggaaagacttttaatataaatcagcctagtcaaccagaaatgggaaatttggattttgatattcaaaatattcgttttgaaaatgaaaaattaaatgtgtcttggaaattgaaagaacaaagtactccccagtttaaagggaaaattgaaatctatgacaatgaaaagttaacgggacaagctttgaaagtaatcgacaatattaagtcctatcaaactgaggtaagtcaaactatgcaattgcctcaaacagcttatgctaaaattacattaacagatatatttgatcgaactgtagagaaaaaagtagcaattacaaatggaaattctgatattttagtagggaatcaatttgcatggtccctaaaaggaattagtgatttcgagtttgctaaaatcaatttcaataagtcgaaagaagaaatgcaaattgacttaaaagcaggcgtaccgcatcattattttaatgaaatatatgcgagtattaaagtacaaaatgcatcaggaaaagtagtatacaataaagatatttatggaaacaaacaacaaaatgctgaatcgcaaaaagttccagtcaaagtaggcgattatattgagttgacacacttagagggtgtgaatagagctactttcaaaaatgtagataacagtaaacaagagagctttggaaaaaaagccatgtacgaaattacaaaagaaggtctgaagaaagtagaaaaaatgccagaagcaacaattttagatggaaatcaatttgtatggtccttaaaaggatatagtgatcgagaaattgcaaaagtagattataacaaaacgtcagaagagctaaaaataaaattagaagctggtgtaccgcattcatacttcaatagtacatatgcgagtattaaagtccaaaactcatccggtagcgttatatacaataaggaaatcgtagggaatagacaacaaaatgccgaaacccaaactgtgtctgtaaaagtgggagattacattgaattaactcatatagaaggagacgcagtaaatgaaaagacacgcgcaacattaacgaatcttgaaaataacaaaaatgagactattggaaagacagcaaggtatcaggttacaacagagggcttaaaaaaagtagaaaaaatgccagagacaacaattttagacggaaaacaatttgcatggtccttaaaaggatatagtgatcgagaaattgcaaaagtagattataataaaacagcagaagagctgaaaataaaattagaagctggcataccgcattcgtactttaatagtacatatgcaagtattaaagtccagaactcatccggtagcgttatgtacaataaggaaatcgtgggaaatagacaacaaaatgctgaaatcaaaacagtacctataaaagtgggagattacatagaatttactcatatagaaggggaagcagcaaaggaaaaaacgcgagcgaatttaactaaccttgagaatggaaaacaggagtatataggtaagaaaagaatatatcagattacatctacaggattaataagacaataa

SEQ ID NO: 404 - DNA, 2364 bp, Bacillus Sp.
atgtttaaagtaaaaataaatggaagaatcaaaaagattgttatgatttctgcggcttgtaccatgatgtcaatgtatggagcaccaatttctagtacagaggcagcaatccgatcgcatgctccatcagtttatgtaacaccacaaaatactgctgcttcagatattattagcatagactggtcaccaatccaaacggcaccttatacatattgggctgtacataactggaatcagggaggagagggtggcggttatgctggcttccaacaacaaagcggttttgatcaaaccggtaaacgtacccttcactttgcactttgggatccaatagcatcaaaccaagcaattaaagctgaatatttatcgccgacttcagaagccagtagatttggtggagaaggaacaggtttgaaggtacaaacaacttataattggaaagatagtgaatggtatcgaatgacactacgttcttggcaagaagatggtcatacaaagtttggccagtggataaaagataataaattaaatcaatggaagttagttgctattatggatcatccagttgcgaatgttccatttaactatggtttatcgatgtttcaagaggactgggctggtaatggacaagatgtaagagaagcacgccttaaaaatggctatagcagaaaagtttcagataaacaatggaattcttggaataatcagcgtatctctgggcaacatgatacctcttatcaatacgatggaggagcaacttcagaatatctatgggttaaggcgggaggaaatactcaatcaactattggtactggaaagacttttaatataaatcagcctagtcaaccagaaatgggaaatttggattttgatattcaaaatattcgttttgaaaatgaaaaattaaatgtgtcttggaaattgaaagaacaaagtactccccagtttaaagggaaaattgaaatctatgacaatgaaaagttaacgggacaagctttgaaagtaatcgacaatattaagtcctatcaaactgaggtaagtcaaactatgcaattgcctcaaacagcttatgctaaaattacattaacagatatatttgatcgaactgtagagaaaaaagtagcaattacaaatggaaattctgatattttagtagggaatcaatttgcatggtccctaaaaggaattagtgatttcgagtttgctaaaatcaatttcaataagtcgaaagaagaaatgcaaattgacttaaaagcaggcgtaccgcatcattattttaatgaaacatatgcgagtattaaagtacaaaatgcatcaggaagagtagtatacaataaagatatttatggaaacaaacaacaaaatgctgaatcgcaaaaagttccagtcaaagtaggcgattatattgagttgacacacttagagggtgtgaatagagctactttcaaaaatgtagacaacagtaaacaagagagctttggaaaaaaagccatgtacgaaattacaaaagaaggtctgaagaaagtagaaaaaatgccagaagcaacaattttagatggaaatcaatttgtatggtccttaaaaggatatagtaatcgagaaattgcaaaagtagattataacaaaacgtcagaagagctaaaaataaaattagaagttggtataccgcattcatacttcaatagtacatatgcgagtattaaagtccaaaactcatccggtagcgttatatgcaataaggaaatcgtagggaatagacaacaaaatgccgaaacccaaactgtgtctgtaaaagtgggagattacattgaattaactcatatagaaggagacacagtaaatgaaaagacacgcgcaacattaacgaatcttgaaaataacaaaaatgaaactattggaaagacagcaaggtatcaggttacaacagagggcttaaaaaaagtagaaaaaatgccagagacaacaattttagacggaaaacaatttgcatggtccttaaaaggatatagtgatcgagaaattgcaaaagtagattataataaaacagcagaagagctgaaaataaaattagaagctggcataccgcattcgtactttaatagtacatatgcaagtattaaagtccagaactcatccggtagcgttatgtacaataaggaaatcgtgggaaatagacaacaaaatgctgaaaccaaaacagtgcctataaaagtgggagattatatagaatttactcatatagaaggggaagcagtaaaggaaaaaacgcgagcgaatttaactaaccttgagaatggaaaacaggaatatataggtaagaaaagaatatatcaggttacatctacaggattaataagacaataa

SEQ ID NO: 405 - DNA, 2364 bp, Bacillus Sp.
atgtttaaagtaaaaacaaaggggaaaataaaaagaattgttatggtttcaacggcttgtaccatgttgtcaatgtatggagcaccaatttctagtacagaggcagcaacccgatcacatgccccatcagtttatgtaacaccacaaaatactgctgcttcagatattattagcatagactggtcaccagtccaaacagcaccttatacgtattgggctgtgcataactggaatcagggaggggagggtggtggttatgcgggcttccaacaacaaagtggttttgatcaattcggtaaacgtacccttcactttgcactttgggatccaatagcatcaaaccaagcaataaaagctgaatatttatcgccgacttcagaagccagcagatttggtggagaaggaacaggtctgaaggtacaaacaacttataattggaaagatagtgaatggtatagaatgactctacgctcttggcaagaagatggccatacaaagtttggccagtggataaaagataatacattaaatcaatggaagttagttgctattatggatcatccagttgcgaatgttgcatttaactatggtatatcgatgtttcaagaggactgggctggtaatggacaagatgtaagagaagcacgtcttaaaaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacttttaatataaatcagcctagtcaaccagaaatgggaaatttagattttgatatccaaaatactcgctttgaagctggaaaattaaatgtttcatggaaattgaaagaacaaagtactccacagtttaaagggaaaattgaaatctatgacaatgaaaagttaatgggacaacctttaaaagtaattgataatattaagtcctaccaaactgaggtaagtcaaactatgcaattgcctcaaacagcttttgctaaaattacattaacagatatatttgatcgaactgtagagaaaaaagtaggaattacaaatggaaattctgatattttagtagggaatcgatttgcatggtccctaaaaggaattagtgattttgagtttgcaaaaatcaatttcaataagtcgacagaagaaatgcaaattgacttaaaagcaggcgtaccgcatcattattttaatgaaacgtatgcgagtattaaagtacaaaatgcatcaggaaaagtagtatataataaagatatttatggaaacaaacaacaaaatgctgaatcgcaaaaagttccagttaaagtaggagattatattgaattaacacatcttgaaggtgtacatagagcgaatttcacaaatttagacaacagtaaacaagaaagctttggaaaaaaagcaatgtatgaagtcacacgagaaggcttgaagaaattagaaaaaatgccagaagcaacaattttagacggaaatcaatttacatggtccctaaaaggatatagtgatcgagaaattgtaaagatggattataataaagcggcagaagagctgaaaatcaaattagaagctggtgtaccgcattcttacttcaatagcacatatgcaagtattaaagtccagaactcgtctggtagcgttatgtacaataaggaaatcataggaaatagacaacaaaatgctgaaacccaaacagtgcccgtaaaagtgggagattacattgaattaactcatatagaaggagacgcagtaaaggaaaaaacacgcgcaacattaatgaatcttgaaaataacaaaaatgaaactattggaaagacagcaagataccaggttacaaaagagggcttaaagaaattagaaaaaatgccagagacaacaattctagatggaaaacaatttgcatggtcattaaaaggatatagtgatcgagaaattgcaaaagtagattataatcaaacagtagaagagctgaaaatcaaattagaagctggcgtaccgcattctcacttcaatagtacatatgcaagtattaaagtccagaactcgtctggtagcgttatgtacaataaagaaatcatgggaaatagacaacaaaatgctgaaacccaaacagtatctataaaagtgggagattatatagaatttactcatatagaaggggaagcagcaaaggaaaaaacaagagcgactttaactaaccttgagaatggaaaacaagaatatataggaaagaaaagaacatatcaggttacatctacaggattaataagaaaataa

SEQ ID NO: 406 - DNA, 2328 bp, Bacillus Sp.
attgttatggtttcaacggcttgtaccatgttgtcaatgtatggagcaccaatttctagtacagaggcagcaacccgatctcatgccccatcagtttatgtaacaccacaaaatactgctgcttcagatattattagcattgactggtcaccagtccaaacagcaccttatacatattgggctgtgcataactggaatcagggaggagagggtggtggttatgcgggctttcaacaacaaagtggttttgatcaattcggtaaacgaacccttcattttgcactttgggatccaatagcatcaaaccaagcaataaaagctgaatatttatcgccgacttcagaagccagtagatttggtggagaaggaacaggtctaaaggtacaaacaacttataattggaaagatagtgaatggtatcgaatgactctacgttcttggcaagaagatggccatacaaagtttggccagtggataaaagataataaattaaatcaatggaagttagttgctattatggatcatccagttgcgaatgttgcatttaactatggtttattgatgtttcaagaggactgggctggtaatggacaagatgtaagagaagcacgtcttaaaaatggatacagcagaaaagtttcagataaacaatggaattcttggaataatcagcgtatctctgggcaacatgatacgtcctatcaatacgatggaggagcaacttcagaatatctatgggttagggcaggaggaaatactcaatcaactattggtactggaaaaacttttaatataaatcagcctagtcaaccagaaatgggaaatttagattttgatatcctaaatactcgctttgaagctggaaaattaaatgtttcatggaaattgaaagaacaaagtactccacagtttaaagggaaaattgaaatctatgacaatgaaaagttaatgggacaacctttaaaaataattgataatattaagtcctaccaaactgaggtaagtcaaactatgcaattacctcaaacagcttttgctaaaattacattaacagatatatttgatcgaactgtagagaaaaaagtagaaattacaaatggaaattctgatattttagtagggaatcgatttgcatggtccctaaaaggaattagtgatttcgagtttgcaaaaatcaatttcaataagtcgacagaagaaatgcaaattgaattaaaagcaggcgtaccgcatcattattttaatgaaacgtatgcgagtattaaagtacaaaatgcatcaggaaaagtagtatatagtaaagatatttatggaaacaaacaacaaaatgctgaatcgcaaaaagttccagtcaaagtaggagattatattgagttaacacatctagaaggtgtgcatagagcgaatttcacaaatttagacaacagtaaacaagaaagctttggaaaaaaagcaatgtatgaagtcacaaaagaaggcttgaagaaagtagaaaaaatgccagaagcaacaattttagacggaaatcaatttacatggtccctaaaaggatatagtgatcgagaaattgcaaaagtagattataatcaaacagcagaagagctaaaaattaaattagaagcaggcgtaccgcattcttacttcaatagtacatatgcaagtattaaagtccagaactcgtctggtagcgttatgtacaataaggaaatcataggaaatagacaacaaaatgctgaaacccaaacagtgcccgtaaaagtgggagattacattgaattaactcatatagaaggagacgcagtaaaggaaaaaacacgcgcaacattaacgaatcttgaaaataacaaaaatgaaactattggaaagacagcaagataccaggttacaaaagagggcttaaagaaagtagaaaaaatgccagagacaacaattctagatggaaaacaatttgcatggtcattaaaaggatatagtgatcgagaaattgtaaaagcagattataatcaaacagcagaagagctgaaaatcaaattagaagcaggcgtaccgcattcttacttcaatagtacatatgcaagtattaaagtccagaactcgtctggtagcattatatacaataaggaaatcctgggtaatagacaacaaaatgctgaaacccaaacagtacctataaaagtgggagattatatagaatttactcatgtagaaggggaagcagcaaaggaaaaaacacgagcgactttaactaaccttgagaatggaaaacaggaatatataggaaagaaaaggatatatcaggttaaatctacaggattaataagacaatag

SEQ ID NO: 407 - DNA, 2709 bp, Bacillus Sp.
atgtatggaacaccaatttctagtacagaggcagcaatccgctcccatgctccgtcagtttatgtaacaccactaaatactgctgcttcagatattattagcatagactggtctccagtccaaacagccccttatacatattgggctgtacataactggaatcaggggggagagggtggtggttatgctggctttcaacaacaaagcggttttgatcaaaccggtaaacgtacccttcactttgcactttgggatccaatagcatcaaaccaagcaataaaagctgaatatttatctccgacttcagaagccagtagatttggtggagaaggaacaggactgaaggtacaaacaacttataattggaaagatagtgaatggtatcgaatgactctacgttcttggcaagaagatggccatacaaaatttggccagtggataaaagataataaattaaatcaatggaagttagttgctattatggatcatccagttgcgaatgttgcattcaactatggtctatcgatgtttcaagaggactgggctggtaatggacaagatgtaagagaagcacgtcttaaaaatggatatagcagaaaagtttcagataaacaatgggattcttggaacaatcagcgtatttctgggcaacatgatacttcttatcagtacgatggaggagcaacctcagaatatgtatgggttaaggcaggaggaagtacgcaatcaacaatcggtactggaaagacttttaatataaatcagcctagtcaaccagaaatggggaatttggattttgatattcaaaatattcgttttgaaaatgaaaaattaaatgtgtcttggaaattgaaagaacaaagtactccgcagtttaaggggaaaattgaaatctataacaatgaaaagttaacgggacaacctttgaaagtaatcgacaatattaagtcttatcaaactgaggtaagtcagactatgcaattgcctcaaacagcttatgctaaaattacattaacagatatatttgatcgaacagtagagaaaaaagtaggaattacaaatggaaattctgatattttagtggggaatcaatttgcatggtccctaaaaggaattagtgatttcgagtttgctaaaatcaatttcaataagtcgacagaagaaatgcaaattgacttaaaagcaggcgtacctcatcattattttaatgaaacatatgcgagtattaaagtacaaaatgcatcaggaaaagtagtatacaataaagatatttatggaaacaaacaacaaaatgctgaatcgcaaaaagttccagtcaaaataggtgattatattgagctaacacatctagaaggtgtgcatagagctactttcacaaatgtagactacagtaaacaagaaagctttggaaaaaaagcaatgtatgaagtcacaaaagaaggcttgaagaatgtagaaaaaatgccagaaacaacaattttagacggaaatcaatttgcatggtccttaaaaggatatagtgatcgagaaattgcaaaagtagattataacaaaacggcagaagagatgaaggtaaaactagaagctggtgtaccacattcatactttactagtacgtatgcgagtattaagatccagaattcttctggtaacgttctgtacaataaggaaatcgtgggaaataaacaacaaaatgctgaaacccaaacagtgcctataaaagtgggagattatatagaatttactcatatagaaggggaagcagcaaaggaaaagacacgagcaactttaacgaatcttgaaaataacaaaaatgagaccattggaaagacagcaaggtatcagtttacaaaagagggcttaaagaaagtagaaaaaatgccagagacaacaattttagacgggaaacaatttgcatggtccttaaaaggatatagtgatcgagaaattgcaaaagcagagtataataaaacagcagaagagctgaaaatcaaattagaagcaggcgtaccgcattcatactttactagtacttatgcaagtattagagtccagaactcgtccggtagcgttatatacaataaggaaatcgtgggaaataaacaacaaaatgctgaaacccaaacagtgcctataaaagtgggagattatatagaatttactcatatagaaggggaagcagcaaaggaaaagacacgagcaactttaacgaatcttgaaaataacaaaaatgagaccattggaaagacagcaaggtatcagtttacaaaagagggcttaaagaaagtagaaaaaatgccagagacaacaattttagacgggaaacaatttgcatggtccttaaaaggatatagtgatcgagaaattgcaaaagcagagtataataaaacagcagaagagctgaaaatcaaattagaagcaggcgtaccgcattcatactttactagtacttatgcaagtattagagtccagaactcgtccggtagcgttatatacaataaggaaatcgtgggaaatagacaacaaagtgctgaaacccaaacagtacctataaatgtaggagattatatagaatttactcatatagaaggggaagcagcaaaggaaaaaacacgagcaactttaactaaccttgagaatggaaaacaggaatatataggaaagaaaagaacatatcaggttacatctactggattagtaagacaataa

SEQ ID NO: 408 - DNA, 1983 bp, Bacillus Sp.
gtgattagtcagaaaacaaagcaaagatttaataaagttattataattaccgcagcatgtagcatgttttctatgtttggaacgtctattttgcacactaaagctgcaacacattcagctgctccagcagtttatgtgagtccccaaaatatacctgcctcagatattattagtatagactggtcaccagttcagacaccaccttatacgtactgggctgtacacaactggaatgcaggtggtgaagctggaggatatgctggttttcaacaacaaagtgggtttgatgaaaatggaaaacgtactttacattttgccttatgggatccaatttcctctaaagaagcaataaaggccgaatacttatctccgaattcgcaagctggaccctttggaggagaaggaacaggaatgaaggttcaaacaacttatggttggaaagactacaattggtacacaatgacaatgcgttcatggcaagaaaatggtcatactaaatttggacaatggatgaaagatgtaacaaagaataaatggcatcaaattgcaattatggactttccggttgctaatgttgcatttaatcatggtttaggaatgtttcaagaagactgggctgatagtggacagaatgttcgagaagcgcgcttaaaaaatggttatagccgaaaattagttgataaacaatggagttcttggaataatcaaagtatttctggaacgcatgataatacttatcaatatgatggaggatctacttcagaatatgtatgggtcaaagcaggaggtaatacgcagtctactattggggcaggaaaaatattcacgctaaatcaacctactcaacctgaaataggaaaattagattttgatatccaatctatatattatgaaaatgaaaaattaaatgtatcttggaaactaaaagaaaatagtacaccgcaatttaaggggaaaattgaaatttataacaatgaaaatatgacgggccaacctattaacgtaattaatgatattaaatcttatcaaaatggaatcagtcaatctatatcattaccaacaaatgcttatgcaaaaattgtattaacggatatatttgatcaaactgttgagaaaaaggtacaaatcaaaaatgaatctccaaacatttttgaaggtaatgaatttgcatggtcgctgaaagggattggagattttgaatttgcgaaagtaaatttaaataaatcaacagaagaaatgcaaattgatctaaaagcaggtgtaccacatgactactttgatagtacatatgcaagtattaaagtgcaaaacacatcaggtaaagtggtctataacaaagagatttatggaaacaaacagcaaaatgctgaatcgcagaaagttccagtcaaagtaggcgattatatagagttaacacatctagaaggtgtacatagagctactcttacaaatgtagataatagtaaacaagagagctttggaaaaaaagccctatacgaagttacaaaggaaggcctgaagaaaatagaaaaaatgccagaagcaacaattttagaaggaaacaagtttgcatggtcattaaaaggatatagtgatagagaaattgcaaaagtagattatgataaaacggtagaagagatgaaggtaaaactagaagcaggtgtaccacattcctattttgctagtacgtatgctagtattaaggtccagaattcttctggtaacgttctgtacaataaggaaatcgtgggaaataaacaacaaaatgctgaaagccaaactgtgcccgtcaaggtaggggattacattgaatttacccatatagaaggagaagcaacaaaggaaaaaacgcgagcaactttaattaaccttgaaaataacaaaaatgaaaccattggaaaaacagcaagatatcaagttacaaaagaaggcttgaagaaagtagaaaaaatgccagaaacaacggttttagatggaaatcat

SEQ ID NO: 409 - protein, 420 aa, Alcaligenes Sp.
MKLLELKSVYSEQEQERFYTRSISLGDWDYSAIIKSSVMFGLGQIPVVGKALSTIVGLFWPKNEKDVWQKSLDELREYIDNQILATIQGILNGELREIQKKMEYVARLLEESPGSPEACSEYKNLQFYLVGKDEKFRSFDELTNYKLMPMYASMILLQASYWKMGIDKKDQIGLSSIDLNSLKNHIDDLADSSRNYINRIYETELDRTYENSRPDEVANNMFAVRGYSLLHGVEAVEVVKNIRDLDFDKRFNINVISYSTAVGTITGGMIAQALTPDSEMAQPLCPEVFGQQANRIVQIIGYSGPRINSLFRIGGLEIIYENGDSSLLGERVGNRDVFDLNGSLIKTVEMRYQGLMDEVKFTLFDGRVMQVGQGESYSGYVKYEVEGHYISGVFLSRDRATYPGRTSTASVSFNMVPAIS

SEQ ID NO: 410 - protein, 132 aa, Alcaligenes Sp.
MKDQFSNNEIEKLSRGVGLETSPADESVQLLSGGTFTVPKHGSVQAAKYSTPVIPEIHKSYWIFNAGKANKIKAVFYWSHSFTSSWFEYSSVEVGIGEEKKLQAPSNSLYYSKVVLFNGTDQNATVSVTVAK

SEQ ID NO: 411 - protein, 360 aa, Meta Sp.
MVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKE

SEQ ID NO: 412 - protein, 1242 aa, Meta Sp.
MKFSGRYKAIHIHTLIALLFGSAAFGPAHDAMADERASRPRFYTPKASGDRASFRTSEFYANWGLNLHHFDAAYAAGATGQNVKVGQLDNPLYVKHPELAGINFSAVGSYPLATTPAFDAGTGKPAYHGMHVAGIIAARKDGKGMHGGAFGATDFVTGNFRQTSQAVQQAGGTLSKLGKTIVDAGADFINHSYGYNFGIYAIPMALPEGQFGSHGPDIRHMQRYRDRQHIELSSANGVVNVSSAGNDRYYAAYKTAFNKYDARPRLFRGIGNGAGINSIPYMNHREKNLTDADWSRIEKGILSAVILNGTKDINSYSNICGISKYWCVGAAGGMLTEPDKAYATTLPALPYPVDFYHPDASGQKYSYEKLNGNISSDRYRILSLAVTSNAPPGSPEAEVMDPKNLQPIYRMAMGTSMAAPTLTAGLAVTKSRFPYLQNWQIRDIVLSTAQDIGAPGIDRVYGWGAMDLEAAIGGPRSLFALRRDYIEKLAQYEVEAADKYNPIVAKADYYATQAYELKIQMIENAKRAAEAEKAGNQKEAAQLLALNKQLAPQEAAFRKQAYEHELTRIQPNNEADTPQNAFEYINFVVNIPGKKSEACAEDACVADVWTNDISGPGGLEKKGAGLLALAGNNHYTGGTKISDGVLQFGIGGTTGSVTGNILNNSSLVFARSDEWSYKDSITGSGEVLVLGGGTFRLQGDNTYTGPTHVYDGRFAVDGSTISNTIIYGGGTLSGNGRVGGIHVRQDGIVSPGNSIGTLTVMKSGSAGAGAGNAVFEPGSRLAIEIDGQGNHDALKVENAANIHGGMVDVGVANLSRTQLAQQVRQSMQKPYEILTAGAGVSGAFDQARLDIDLPFIAAGLRYSPQTVGLVLGRSHLGFGSVGQTYNQRQIGDGIESLSPGQPLYDGLLTSASRQEAVSSLQQLSNVDIHASLKRTLIDNTRFMRDAALGRSGFASMPNIGASADGKLLGETNMNVWGKVLGSWQKHKGDGNAASLDRTIGGLIFGVDHLMNRNWRAGALVGLSNSSLKSDRASAKIDSYQFGAYAATERERLGLRVGASLAHHEIATRRGGYPDLTSMNKADYSANSLQVYGELGYKFTANAVMIEPFVNSAYVHLRTNAFEEDGDASKVSGKRQSANVVSSILGARISNIVESGSGTAFRLSGMIGWNYNVGDIAPIASVNYRGGNTFDVRGIPLSRNAFVTEVGIQASPKKNLSAGLYYDGRFGRKVSDHSLSLGISYAF

SEQ ID NO: 413 - protein, 1395 aa, Meta Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINGKPAALATDSTVDCSDDGSQQMAEGSKRVFINSQPASRIGDRTTCDAKVMTGSDNVIIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFVLPSRLPVRWQRYWRSGNPGDSVLGRGWSLFWESRLEPYQDGLVWRAPSGDYIAFPNVPKGMRTYCESEKNWLEHHSDDSWSVYDVSGERWHYAPLKDDAPSLLQRISEPCGNAILFEWNANNTLHALTDSAGQRVVCRYDSDRLAGAWLDDEICLVSYAYDEQRQLVCVTGRGGSVRRRFRWQDGLMSAHEDANGLLSEYRWQEIDGLPRVVGFRHSGGEQLTFEYDFDNGTRRATRDDGAQAHWLVDDDDNVARFTDYDGRQTTFVYRDGELCDVILPGGAMRRSTWDKYGRMTSETDPAGRRTEYHWYRLTDRITRTVYPDGTSSQAMYDLRGRLLSETDPAGNATAYDYPDDQENLPESITDAIGGVVRLVWNHQGLLTQRTDCSGSVTRFTYDRFGQLIASENAEGNITRREWSRAGLLSAVIHPDGSRESLVWNERGQLTGWRDPLESEVSWAYNALGLPVSLTDRIGRVRQWRYDPRGNLLRLDNGNGAEYRFTYDAVGRPLSETRPDDTVRHMEWDARGFLCALEENGRPAADGGIARRVQQFSYDDSGLLIGRTQRHAEYRYFRDLSGQITRIRRTPTAEGVALGIESDEIVYRHDANGRVLSESGINGAVGYEWDALSNLTGLTLPGEQKLAWLHYGSGHVSAIRFGQQLVTEFTRDRLHREVRRTQGAREQLRQYDSLGRRTLQRSELSTDVTLPEKALLERLYRYTARGELSGVSDTLRGEVDYGYDAEGRLLKHYEARQGHSRAQFSYDAADNLAASDDAAPVTDNRLQHWQALFMKYDHWGNLVSRRNGLYEQHYAYDAENRLVSARGTGPEGRFEARYHYDALGRRTRKIVTTTHGTTETRFLWQGYRLLQEQQESGLCNTYINDPNEAWSPLARVDHLRDQNSGEIYWFNTDLNGAPLEVTDERGAVRWSGQYGSFGEVRHQSEGFSRLVNRTAMAHQPLRYAGQYADGETGLHYNLFRYYDPQVGRFIVQDPIGLNGGWNLYQYAPNPLGWIDPLGLLTYNTMPSITGFQKHHIIPQQLKGHDLIKAADFNIHDIKNVIYLPKSADYHPTRTIHSGSHPVYTKNIGDQMDAIYEYGKENGWKQAEYKQAVSEIIKNERADLRGGKTILNKNSVRKARC

SEQ ID NO: 414 - protein, 555 aa, Meta Sp.
MHPIARSLLACGAITLLTIAPTQADPASQQLRDQQQAQRQREQLQQLERLQRLQPITSHDDRSAFTDTSDNCWSITGVRLTGNQKLPTHQLQPTVQALSQPCMGIASINQLLKGLTQQYVEAGYPTSRPYLARPPKHEQPLDIVIIEGFVESIELTDGELPLSLQGAFPGLLGKPLHLPDIEQGLDQLNRLRAYDLGIELLPGELQGGTRVVLQPRQVTSPWHLDTRLDNRGSELVGRHRLNLGLGLDSPLGMNGDLRLSMASTVFNAPGQSRGLNLYYSLPYGPWTFTLNASRMSYRAPVPESHIVSNGKSRFLGLGAERLLWRNQRGILSASARVDRKQLITRSDSTVISLQSPTLATLEAGLNLLWIDRGLWNAYLGVSQGMDWFGADRPLPQAQTPRPDFLKYRVNLLHLRQGPGHWPWRWQSELTGQYSADVLPAVEQFQLSDDSAVRGFRQHTASGASAAVWRNTLSQPLDLAWTHSVQVRPTVGLDLGWTRFARASASQRLAGAAAGVELSLPQSRLRLDYQRALYASDKPAKGLERGYWVLDWTLTI

SEQ ID NO: 415 - protein, 1042 aa, Meta Sp.
MTIPERRLLPNAADKTALKAIATSIVQTCPSLLDAARQVAIELLTDKGLSGLDPDEVYFHRFKTAQSSTLTFTGWEHLLEKPYETLTLTQLVIHRFRATDQDNADLLGLYCGFYSDGPDAENFNQDNEVRLLGSDVLKAFWAVDFSTRYTGQLTKFWQTSSEDFRALAKCNFLSQAVQALQEGDVDGNDFQRIVTSLIGPITWPITLQMLRATYPVGAQVRTLDLDGHVATNVLRLVEDSGRQTLYLPGEPQAFRLMDTAADLHWWLLDQMNSEQKRPLFLKHFSLADSNHITENLTDLMNRLVSTWGHSDHRMINRSNVAISGDAFTWLSESTRAGMAAEAHLVLTSNSDLRKKLWTGYLSAGLKVFGPMAAVGWPVALPLIGAGIANMGLNIDQAINGITAAERRAGVIGAVLSAIETVFNVPFLIGTGAQLEVGPQVEYAGAEEMLGLIELSSADTPSLPPVDPPPVTGTEAATSELTNEIPEEATSVTATELLTMTATRHGPTFPEVPASYRCNELLAQHSVEATPGKYEGIYRLDKEPGYAIEMDGQAYYVRYFADSQDSGNWAIVNPERPNQFAYSLPVRFGSAGKWERMPALRLRGGGQCVGKACAPETEVSSSGGTPSVEMRCLEPLPGVPCPLRLVTKLKGVSEKEKPGMRRWAMNLPSASAESAGARRRFLSTTERYVEHFSEERRALLNKAEKFHRELKWINLPERPDIPQISPQMQVDDLIDRIFANTDGLAVGETLDRIASMRFMIENMPAFARHIQTLYVRGLLSDFAQNDLNQFFLSGDMSEDLRTYLSGLGTDPENRFNVLELVKTAQANGIRVHGLDAAHTYTLKRPLLSIEEQMIKTRLSTTIIEGDKLLNRTKKWVALVDATNINMFRDLPGISELRGGIGLRIEEVWPEETADISIDPGVEVARGPFYNWAMTSNAFDVLFADLRLQIKSPMPQWNAAALEKLLHRNGMFVIQKTEPDIYTLVRRNSDSDIVRTRVHCTTAGRFYIWDLSMPRITGRNFHDIAAVAERLIELGFTLQSRLPT

SEQ ID NO: 416 - protein, 1550 aa, Meta Sp.
MPIKIATKGNTTVDVHLRPDTPVDPPALRPDITLRPGLEAETLTTPPRPGSTTGSADADAIGLAPTVTVHPTRSGQDSVDLGDRSLEHYRLSLTPSLPAANTEGLRLFKGRQYVELADGGLVQVGKESQSGLWRATLASELTPTGPAMLRNPDDGLWHAFEHSQPTTFALSATRLEDFRTALDFSSAIGDSDGLHRFEGKLYAVIDNHAYQVLQDLDASTPWSQVMRIVRAEDPVAVDADNHYVASRPGRSQAIVLDPSEGWVGVSTGGAGGMRRAERNPSARRSLAERFFAFTHRSSRPEARVRKLYPSFDDQQVAAFLRTLGDDVDGGLTTKETEYSNLEKDLQAWTATHKHLTVPSAQGPVTNWANTVANGIKRCWSQETTQLRFPLSHAPLPALRADFNHVRFLEMDSVAWSPAAETFLSGFSGLQSLKITRSGLEKLPAAVSQMHNLTELNLRTNKLQLDEASAAALGGLANLEVLVLTKNPLGKLPDFSAMPNLQELDLCATGIKGWPTGLKGLTALKKIDLRHNKLQEVPAEHLNPADDQFEAIVHINRHILLENNAFPADYWQNFERFWLQAEARKAEWAAGALEGAFRLKEGIGVIDRTRNLYAHLDVAGAKKFIMGLGDDTDAVLTRRSEAFAQLDTSLDAYKQSCALLSNAGQRKRALETATAIRQCWLDQTQTTLTLDYLGLVGISNKQTMLPDLSADFGHVRKLTLIGVEWSPAANTFLSGFSHLQHLSIGNSTLDKPPTMLSQMQTLTWLNLGSNQIELDAQAVATIAGLNRLTHLNLSHNPLKITPDVSAMSGLTTLNLSHAQISHWPLGLLNKTALTGVDLGSNLLTDVPEAHLNPPADQLAAVARINNVTLLISNPGIPSSYVRKFEGYWRRLNTAHPELMTPVHPSAFDHDKSRAQRYHRLYPAKSINDCRKYLWGLEPGTVGTRLSQLEREFAVLNQQLDAWVFSGGGNRQGYIPANQLMLNAENRADRTTARDRIINCWRQETPQQTAFDGTSIGLELDLSGLNLPSLPDIDADFSHVGSVKLRDMHLSASPEGFLTRFRHVRWLDLSKNQLRVLPPAIGQMNGLTKLFLQHNEISLTVDTARILSERTTLRALWLSNNRQLGIVPDFSRIPDMRSVNLASTGISEFPVGLSAQPSLDTVNLSNNRIEQIPDFVFDAVPFQVNDVTNIRFNQLNNQSRARLVEYAGRLAAAGMFMSGRNNLIDTGLSMNMPNIRALLLDTMTRWTVGLPATEVATRRQQWQTVRDEQGSDGLFNTIDRLLSEPASHPDLQRRVWNLIDSITENTAQSEHLRREVLDRAGDPACCDRAAFTFTNLEVLTLAHKARSQARDEAQGKQLSALSKALFRLHEVDKIASADIAQREARIAASRTPEEARLFGPPRVPEEIEVRLFYRFRLKDRLQLPGQPERMGFARLADVSEAQLNAAYEKVIAQDNSPEEFQALVAREFWQEFITHKYRSQFETQRDPFQTRQATLDDAHSASELSFVDYKAQSMSLQAELAIKEAELITTLSRQELSEYAMQNSETAAVETE

SEQ ID NO: 417 - protein, 165 aa, Meta Sp.
MSNYVKKFAGYGFAALVAVTAIVPAQAMPLPVVPSQPSVNPDVVNVQYYRDYDRGPRRGYHNGYRGYREPRPGYRHHDGYWFPLAAFAAGAVIGGAIAAPNYRPAPVYRPAPVYRPAPVYRPAPVGNLNPRHYDWCAGRYRSYDAYSNTFQPNYGPRRQCLSPYF

SEQ ID NO: 418 - protein, 434 aa, Proteus Sp.
MSSTLKLNDGLSDIGSIIHYGISQIPVIGGVLSTIFGLLWPTDKEDIWSTIKQEVQSLINEDIQEDDWNRLVAAVSELQDKVSFINDQLINAQYDTAGPELMTVVVDIIGIEENFKIEGTNFKYAFAPLFVAAVNLKIALYLEGIKYSNDLGLSQDQVNQLKSLLQKDVQSSKSYLSPINSAIGNTYLNNIQTYFSVKLYYETSVSLFNELWSGDYEDYNAPAPLENYYVPVMAAGSFYKLISLDGQNFSVPMAFAEVADNSMMPSTNILGSLYQEPTSYPDGYINFIDVYTDLSVSHRTTGLMFTCSGSDEQYEMGMTPNNNDSFNVGQNTMSINVEGGEFINQVSVRADSFVSQIEFTTNLNNTMVAGQHPDDDPIQEVTLVSPFSINSMYVVSDVAGYIQSSGHQMCGIAISAIYNNELAMQYVSSLYKNS

SEQ ID NO: 419 - protein, 100 aa, Proteus Sp.
MSTNYVIQPLETVTVWDDAEPIIPTVTKSVIVTNNGETKLEVVNYWAPPSHVFYPDTTYWVEPNDTIIVQAPERSFYYYRVNVTNSDDTKVGAAIVEIVD

SEQ ID NO: 420 - protein, 1473 aa, Serratia Sp.
MAEIWAARKDDELIHTSALADIASAVAEVAVYAVATAAVSAAAAAAAPALAGVAVLGAAATAASGCVGAGLIVGFATSLTGVGEHISNGCDAVANWLFPPSVSGVILTGSPNVFTNAKPAARAAGRLLTPAEIKALPAPQPPQSFWDYGAELLAAGGNILSQLWQPGVAGPSQPSQPLEEDKISCDKHPLPQYLAEGSSKVFINGQPAVRSNDRSTCEAKVSTDVSKNVQIGGGTVVVRDIKSGKLPGIGLALTVLPLLLGNPAKLVKNLPCMIGGGLAAAGVNALGEAIHAAFNPVHAATGAKVLNDEEDLDLLLPARFPLIWQRNYNSRNGYQGLFGHGWRTPFEIWVDLNDRDGVIECCLHDETGRELRFPLPEVNQPSFSAGEGLMFRRGEEGQLLIADTDGSVWRLFVPLPQTPSRLRLVSLSDEYDNALLLNYDERQRLSHIVDSAGTMTLRLEYGDPRFDDRVTALRHNDEPRVRYRYDGGGDLHQVIDAGGLVTREFHYNAQHLLTRHQQAGGPSFAYRWAMFDDWRVVEHRDSAGGGCTIDYDLAAGLTTVTEYDGLRHQHRWNAQRLIVEYTDERGEVWHYQWNDEDMLIATRDPLGHGWHFRYDEAGNLVEEEDPLGHIRLTGWLPQRALPISVKEPNGATQHFYYDERHALIAEIDALGHTQRYLRDGYGQVVQAVDANGGISHFAYDEHGQLLRARDCSGKQTLYKYTAQGWLSEVTDAAGERVHYRYDAAGRLTQLQRAEGWQETLSWNAQGQLDRYQGADGRLTHYRYDAAGRLLATRNPLDGEVVRHYDARGRLTALRNENAESYLFHWTACNLLQEEIGLDGVSTRYRYDECRRVVERRFAANTSAAFSHYFSHDGAGQLVSKQTPDGETRYRYSPLGQLLHAASYRGNAWHDEPTTAQSEVSFDYDLLGRVTREQGANGTLRYDYDPMGNRTQTTLPDGRTLRALYYGSGHLLQLALDEITLSEFERDNLHRELSRTQGRLTSRVHYDRLGRKDRREIFNDNRQRPAPASSSRQWSYDYQNNLTREEHNANPFSYQRYQYDATGRLLSRDGTRPDTERYRYDPASNLLDEGQFRQRHNRVLHYQGIDYRYDVFGRTVEKRKGHYRWQYLYDADHRLCEVVRYSQHRSEAQQHVHFHYDPLGRRTQKRVWQQSQDLRQPAGKCQTTTFLWEGFRLLQETRDGMPLTYVYADQGSYEPLARIDGHAPAQVFYFHTAPNGEPESLTDSDGTLRWQSHSSAWGRIKYEENQQDLDYSQNLRLQGQYLDRETGLHYNLFRYYDPDIGRFTQHDPIGLAGGINLYQYAPNPLGWVDPWGWKPRCAATKANDHNQAAFGRQWQGRGIYKGRDSWSNIMLKEGDIVYGGAPGQSGFYFNKATLDAAGGSRAKLWESLQVLPHEKFGYRSKIQAYRVKRETIAGTGKAISQDPTRFGEGGGTQFFLSNYKTVLEPIDKPFEIGL

SEQ ID NO: 421 - protein, 114 aa, Shewanella Sp.
MSDLEVKIGVNPADVRYTANFKVAPNDGYVMYEKNTPIIPEIGVNITVINTGREEMEVHYEWAPPFGGWQCASTTIIPPDGKPVYIAHPSNAFYYQRIIAYNKKESTAFGNCEY

SEQ ID NO: 422 - protein, 427 aa, Shewanella Sp.
MNNEYIVTMEKKNNIELKSSGRYTLDDFYHDHAYAFKVALTIGLKKIPYVGSILSTLVKILWPTGASGESLQNLWEMERNEIQSMIDEATLHTINDILNGIVNSLGDKIADINRTIENYGFAAAKDDYINLISNYIIGLEEQFKFESEGSEFIAYATMPLLSITVGLQLSYLAFGLDNKANFGLDSADIDKCSRNIDEIYKDVKKYIEKYAKWSDSDSYSNANSENIYNEVMGSRAFCALNGFEHIEIWSEIQSRKSLDFSIISTSVSYSVEVGVLTPNMTRMATAVEVGPPLLPVMVDGHRNKIVKIEGWDSVEINSYRRVGCLKITYENGDVYDMGVKTSNPVSISLDGEFVDTVKVVQGDTYAINYIKFTLTDGRTMSVGEQSGDTQLLGFDNHTIAAIFVDEGSSDKISCVSVSCIPKQYEEE

SEQ ID NO: 423 - protein, 457 aa, Sodalis Sp.
MNSESNTALDVTNVVSPMMTRGKSKVPLPQWEWDNACDIKYWMIKLAGFIPEVGAILSTMLEVCWPSKKENVWQQILHEVENMIETSKLTIIQGVLRGFINEMEGKVTHVQFMLETHPGSREAHDAYMSLARYLIGMEEHFCSFDDRTNLQIMPMYTASLMLQVMYWSIGVHKSQEMGLTAREVEEMQDIIDRLVDRSSAYCHALYDTEYDEIINTSDAYDITNDLLSVRGHCLMHGIEVLEIVEQIKARGSKENIILKTLSYSEVFDRVTPKTKLQALTEDDNMVAPLKPAWLGNNYAQIRSLVGYIVRIGGAPRVGGLGITFTDGNTYQLGTITREYRNLELNGSVITLIETWGSGAIDEALFTLSDGRTFSFGQRYSYNYRRFEAPGHYITGLYLASDEPSLRGQAAGIMASYHLRNDPATPSTPVSSVPRPLKSLPRRVAVSVSAHGEGRTRD

SEQ ID NO: 424 - protein, 139 aa, Sodalis Sp.
MTISITVSVSHNDVEFDGGKLDRLRHGAAIAADDHTARVTEGEMRIEPRSSLQATRTDTPIIPESRGRFYVANAGKAKQVTAVFYWSHSFTSEWFEYSSTVIARGTDGIVMPPSNSLYYSKIVIYNDTDDVAFVTAYTL

SEQ ID NO: 425 - protein, 451 aa, Sodalis Sp.
MTTTIISTKKNGPGLRHGHVSTPESRAYFAWQEGRLNSGQLNQREAGKFFPATASGLTDSVAPTDSTNMLPPPDGKIASANQGDGEFLDEPGTHWKKHSVESAELLKVTWYYSAPHATRRWNYFITREGWNPNMPLSRAQFEDKPFYKVELEEQPFWSHAAALNPPNPTEHLVMLPQRSGYHVLLAVWEVANTGNAFYQVIDLDFIGDVSPTTPVAPGGLRASASTTSSITLKWNAAASAAEYRLYRNNTLIYSGDQLSFTDNGLPENTTYSYAVSSVNEAEVESAFSQPITASTSSDVNPDTPPTAPTHLHSMGITTNSVSLMWGASSSSVKLNGYLVYRDGNEIARVNVAQLSYTDTGLRPATAYRYFVVAEDIQGQLSGTSNVLSVSTDKDEDDSGGGTYPHWILGETYHAGDIVSHNGKNWVSYVTHVAHSPDWAPGLALSLWYELI

SEQ ID NO: 426 - protein, 1009 aa, unknown
  environmental sample
MKKKTLILIALYLFVQLTQAQNNDKIPQVVLPTPQAQLYEKYVNHPTVEYTGTPEITIPLYEITVKGLKIPISLSYHAGGIKYGQFDGDIGAGWTLSTGGYRVSRTVYGQPDEQYDMYDPNELEEMWNRPWTGDIRKKIERDTYFMGLERKLHQEAYVRTQDSQHDLFNYILPTTTGQYIISDKRNKTVVTDKQNGDKIILDEGGSLSLNSMKIIDTGGFTYLLGGQQTNPSALLVETTLIPGTSASFADKAGWPLRQIQSPYGGNIDFTYKLYELPSENRFGGSFTLTDASYFIASAATGPQYSTASGSVSLSNGRYKQYYIEKITTDKETIIFKRLGFSVPGVSPANTHALSEIEIRAKDNTLVKKIIFNHKKSPEGNTTIDGFWHMLLTSVSISNGTGEPQTYSFAYNEPTLSSPVYADQWGYYKNAYEGRPGGRIIWNKLFLHKEFADEVLMPWTNPNHSYEPTPLKYVWNGTYPGTASYNFVDRSNNSSAGLHFFSLSRITYPTKGSIEYAYQPNKYEAGGETISGSGQRVWKIISNTEDGKPSIVTEYTYGKNGDGLGSVSSSAYLSDRFFATTTILSEIISSDVTLVSSNKFSQVRTYSSSPYQADLLDLMTVVYPEVTTSQYDTSSRSYNGKIVSTYHIPFKIGCSSIGGTSIQLGNYPPPTKYWNDYYINIYNFGNQPYLKSRVTYNNSNLPLIRESFEYENLKSQIFKGIRAIQKQSCVDRPVFLYYELYESPYTYIDPMCIADRIETTLNFNRIKSKEVVSFEGSDSIKVTETYQYDALNRVTRSVTTNGIGSTRQIEYTYPSSGQLVTKNKIGEPVRTKTINNNIPTGIVEKTYPLNAINPSSLRSSTGNESTLRTDITYNQYDSKGNLLQYTRADGTIVSYLWSYNYQYPVAEIVNASYTTVTNNLSGVTAASLAGNANPDDTVLSAVKALRTLLTNAEVTVYKYRPLVGIIEHTDPQGISTWYDYDDLGRLRETCFKEFGIKRILESYDYNYRNQ

SEQ ID NO: 427 - protein, 159 aa, unknown
  environmental sample
MQEDTYRGDGLNLYAYCANNPVTYFDPSGNNGLLNCPQPGFAPGNGDPETLYHYTNEKGKDAILESQELFPSLKANNPKDARYGNGQYLSDINPTTTKPASLASKFIRTPNKYKYTHFVEIDVSDLNVVRGRDGVFVIPNNNSLDISGRIVSSGKVGSQ

SEQ ID NO: 428 - protein, 722 aa, unknown
  environmental sample
MKRKLTSLVVLFLFTNVSYISAWAEETSTVDTSSTEQTSQPATSEVEDSTQVSSTDQVTTPSIHVSEPAASEEPTEPSNEPEQEVTSEAPKISALAAVGDGTEANPYRVTTFQELKDALGTLVAAGQTQYIQLQNDIVYNATGISITQNTVIDGNGNALLYSGTTYDPAQFRTGANNISITYKNLSFGNSTYPNSTWYGILYTGNSGVNFTVENINYTIKNGNQPFWGNNGSGNKLTFKGKNNFYSSGSSYGGEFVEGYPTVVFAEDSETTVYNDSPNATGVFYSTGQSVTVEKRASVSIESSKDYLFYNSATLNVQEQGKFSYKTIRGTNYSSNTATLCVGTLTANFANDSIGHFTTDVNSFTGSNPIVNLNSPDYVVFDATSSSKKVIDTMNPIFKRTDSDTSLYKIAYLTASGQNTYVPKVNSGSSYTVTSSNIGNGYSVAYAKMPSIEAPAVTAATGPDISNIAAQINNAAPATTLSSKVQYKLANKQLYSGDLAADAAQSSIEQAETADDGIIEKKELALPGDGLPIGDDTKHTFVHLPPGNYHVYAKTNDQRVAGYTFESLWKESTAEVQPFIQVQFSSNAMSFNSPIPGQFGKQQNLDNYTIRNAGNVPTNINLTSITRNSDSSEKLSLVEQFDTNNQELLLSLIAEKAGSGTRTTFGPLVDKDPLSLDTLQLDPFWEADAQADLYLAGDYSGPMIGPQNFSYRFSFAISAVTTN

SEQ ID NO: 429 - protein, 222 aa, unknown
  environmental sample
MFRLYEEFKTIEEGKTWGEKYYMAWCKRIIDDPKVLTCNHQDKANPDNDYSFTETKLSIFHAYMGNSAKQFINPSLRNQCITEFENFYISNLAESLDLAPKLDRNIVVYRFVNRDIAEQIEKSSRFNKFTEKGFLSTSLTKNRSRKYDTDLVLLKIYLKKGSIGAYIEPLDNRGLEQEFLIQKGSKLWKKKKIKQQQLIATSLLNSPSFKIDLLECYCITNK

SEQ ID NO: 430 - protein, 405 aa, unknown
  environmental sample
MTQISALHLAAESTQPPLHMLTLQALNMIPPASFSASAMSPQGIATTILSMVLKLVYKKMTEPKEVDVIGIIQETLMKNTSEWLESEYQAVRKDAESLQDAISSWQNSPTEEARQLIVVRNEIAVADMRRLCILSINTAKSRGIVRLCGVCALSCLLYFFTLRDTLVFGKSWGYASDVLEKYSKALTEQADIMFKDVLTAEINNYTENDDFYDPESQAKRSVIYWTSGYTNIQEHLTYGAQQKPTRVCPERSDISANPVDGENHTVYLGNLFLTDSNSSADGSYNYLSAAEPRSYDRSGDPVRLPVRSAGLYHIRLYYAYMTNSLSFDYETQLKIEQAGKIITDAHLTDLTKTVLTPYKSGSNYGPVIYRETQLHLEEGDIVLTFHEDRSLSGGGLLQHVEFVKV

SEQ ID NO: 431 - protein, 930 aa, unknown
  environmental sample
MITPQISNIHAGTPTITAFDNRHFTVRTLQYYRQPNIQQDVQERLEFHYFNIYGFLQKNADARLSESGQDNFYYHADLMGFSLLNKGVDSGEIYQLNDIEQRLMVSIDANKTFKWCCYEANDSLGRLESVSEKIEGGNWRVSERFQYAGNSHTEQLANLAGQCISHFDTAGLLQTQEVSLQGEPTLLTRQFIQQVDNAEFNVDWQEDSDLTALSPEKFSHQTHFDAAGACLSIIDAKGHKQQREYDITGQLIRTTFTVKGQDTQPITQIIEYSAVGQKVREIYGNGAVTEYVYEAQTQRLILIQTYRPVNHSLGYKLFQSLHYDYDPVGNVIAIYNSAEKKVFWRNQKVEPKHRYQYDTLYQLVHATGREIAGISQQSHYLPHHSSIDNSVYTRYFRAYSYDKGGNLIQIHHRAPAMQQAYTIKMTTSSRSNHAVLADLAEFPHQVEPLFTPSGQQKQLLQGKNLTWTSRQELQSVNGAGGNEFYRYDGDSQRALKITQYNQKQSKVVYLPNLEIRQIEHNEKYHVICIGEDSEVQAQVLHWEIGLPDKMVNNTVRYSINGLTSNSGLELDMDGNLISQEEFYPFGGTAVWTVSSALEVNYKTRRYSGQERDITGLYYYGRRYYQPWVGRWLSADPAGTIDGLNLYRMVRNNPLTYQDEHGLAPRLFDTQDDMFADFQQTVSKLLNASSKIERIAKNPSLIRNRVISMAQLFYKDKTSKFTYAINLYEFLEMDSQSEEFKTWATNKLSYQNTSRQRQPGWETVNHAEQALIRTLTAHDSFNISNLIISQKAKLCSSCENAMYTFRQSMPKRRFTTMILRDGDLPLAAIQHGQSRTRYKNSSYSAGVAVGKTSFTLYDYKDIEFQVGMGNFWGGMDKTLYTMYANEFERVFGNLPIGKGVKKSFPPKPPKSSGGRGHQLDKNQPSTSRRHR

SEQ ID NO: 432 - protein, 519 aa, unknown
  environmental sample
MNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCQFYFYDTGDLDLIVNHVQPGDIVSLDIQFSVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESA

SEQ ID NO: 433 - protein, 720 aa, unknown
  environmental sample
MNSPSSKLNSKLPSSLILSTVIWFTAIGLIVPSYAQITYLDDLPTLGSNAFQFEGTQSGDSTERFLAEYGQNAANFVSEEKKQKKLADMAQDYARHKAANIATDEITQWLSKAGNTRLNINLNEKLSIKTSQLDWLVPWYDQHDFLLFSQHSIHRTDGRLQSNNGIGLRHFHQNSMVGINAFFDHDLSHYHSRLGLGLEYAQDYARVSTNSYLGLSTWRSASELAYNYYVRPANGWDIQLEGWLPAYSNLGANLKLEQYYGDDVALFGTNERQKNPMAATVGVNWSPFPLLALNVEHRIGNNGANETGAKIAFNWLLGRSLEQHLDTSVIEANRHIPNNRYDFVNRNNNIVLEYQKKTLISLSLPKVIQGVTGEERSIIRNLTTKYPIEKIVVDAPELIAAGGRLHLNGIDSSVKLPSYKITNNALKNQQLNLYRLTVTVYDTKGNVSPQVETLIEVTGTGALTITHENTKKRNNGIADGKDANTFAIVIKDPLGHPVPNAKVNFVLPANLRSIDQKNTGYYSLLNHFMWKAKAKKAVSEQKYNIIANDKGEASIQFTTFISGSYVVKANTEYGPEINEMYHFKPDISQSFISSIDIIRNNVAADGISKNKIKLRIINNSRQSIAGALVHFEASNGIISPANLTDEYGNTELEISSLVEGSIDIIATLNGDSRTIQVNFLKYAPTSYIQPSTESLFKPSINEQNRHTSLSLLRELFQKIG

SEQ ID NO: 434 - protein, 732 aa, unknown
  environmental sample
MSSVKNNLTHRFEPPSYAERPSYAGAASDKPSYTTEQAAEQITRTGYRWKERNPDGTTPISYRFFTPSQATYNTPAGANEFSKHQKEQARRALQSWADVANISFTENAPDANGHLILGNDPQTGLAGYASYPGVYNNGTQAWFASGGSNYFFTHGSVSRYVLAHEIGHTLGLMHPGKYNNGGSYAENARYAEDTRAYSLMSYWWAGHLGHDHNKNGQTHYASAPLMDDITAIQKLYGANYKTRNTDTVYGFNSNTGRDFLSLDSPDDAPVFNVWDGGGNDTLDFSRFHQAQTINLKAEHFSDVGGLKGNVSIAKGVTLENAIGGTGADRLIGNHADNRLTGGLGQDILTGGPGKDTFVYNNASESTEQRPDRITDFTSGEDRIDVSAALRAAGLKDLHFVRRFSGRPGEALLGYDPRSGHHSLAIDLNGAGQADLFIKSQGPIKPGDVISQASHASTAPTRPFQVTPQPPTPAKTAPYEPRRETMALPQQAPFSLQNHANATLKGTPMHTAARAVGSIREVSVSRDSWGYERVHTRSLGTGSLINDGNSVLTNQHVRDALAKGSKLELWLGYEQDSAGRMKVERKVPLAPTPLSGDARLDYAELPVDLPAGEKKALAEQFPPLKLAPGPQASLGQKVFMPNHGQEALGISFLNAKGQPTTLKGYDQGSPYQGTVYHDAFKKPGTSGSPLISVDTGEIVALHNGSISANVNGHRASMGTATRIDLIQQHRRKR

SEQ ID NO: 435 - protein, 538 aa, unknown
  environmental sample
MQGAVRGRRCTWDVRGRPWLTNSGHAGTIVILAGKDLVPVAKNSYGVGASTQKSKRSTPMSSEFRNSHLRNPVAPIEDPGRRRLMQSALAGSACLVAAPLLAHQGLVDSWGEPIGREAKASAGDDALTVLRESLLAGLNLVPVVGGVLSYLGALFIPAVGNSAEQLWREIVDARISEALLQLVKADLFGLTGIVQLYADAVRSGDLVAISTQSIAANTQFVGAVPRFAQVGQEVSLLPLYVIAASLHLALLRDMALKAVDLGYTPAYRSTLEAQAKDCIARYTAHVDRYVAAAIQAARVNNPYDWRKGDYYESNKPLTQMLQVKAALQIAVIDMRDTWYAFDPVRFPAPVAVRLNREVLSPIIGKWDRKNISPDALPTWQPPASRIKELGLSTFSTAGGASWLQGIHVVYQDGSELETGSRATQGKRLFLRNTSFHLSRVRARYLQGITRLEVDHNNGTFWQGGGPNSGANTASISYTGHRVSSIRSVGHGRAPALTSVGSLIVGFQLLNQEAVPISLQSYDRLAPNMAPQLLRWIAD

SEQ ID NO: 436 - protein, 872 aa, unknown
  environmental sample
MNYNFTHKMKTKSIQTLSVFFVLISFFSYSQKQKRLITNYILTNQIRDFKKSDLIDFGIDNVDQSKSLKGEIVKIQQKFKRLPVYNAVGTALIKDEKIAYFSSSFLKNYNTSTSNIATLNKEKALERIAIALGKEDIKSFQIIENPEPAPAHRNFVKQNLTFVEVDNNLKLAYQFYLHEPKSQNSWNILVDANSGEILNKENLTVSCNFHPDAYGHDHSNEKFSESINKIFTSSSFLAPDNASYNIFPLPIEAPFFGNRSVVNNPWILTASPEGWHSDVTNHYTNTRGNNVYAYEDTANTNQPGFSPDGGASRNFNFPFSVNGTPSFNRNSAITNLFYINNRVHDIFYQFGFTESARNFQQNNFGKGGAGNDYVLAESQDGGGLNNANFTTPSDGSRPVMQMYLWSTVNRYFFYNAPASAIPRIPQANPAQFGPQLNGTGVTGEIALASNINGCSALPAGSLAGKIGLIERGGTANCTFAVKVKNAQNAGAIAAIIYNNAAAVNFPSSMGGTDPTITIPSVLITNDEGEYVKTQLNNSVIVNVTLKSDPATALTPDGSFDNGIITHEYGHGISNRLTGNGSTCLLKSQSKEQMGEGWSDFFALMLTNRLGDNANVPRSIGSYASGQSTNGAGFRPAKYSPDFSINDYTYGDTNGMEIEEDSEIVPDVHRIGFVWATMLWDLHWQYAAKYGYSSDVTSNMSNGSARVLQLVTDALKLQTCNPTFIDGRNAILSAEMLTTKGEDRCMIWKTFAKRGLGLNALAGNKMNISDQVEDFSIPKDCTDGNSNIAIDRSLVKIYPNPAKDEFFIYLKDYTIGNVHVQIYDMSGKLVLSENRSSPDSRIQVSTRDFESGVYVVKLQGIGIDISSKIIIKK

SEQ ID NO: 437 - protein, 676 aa, unknown
  environmental sample
MEIKLYPNKFLVRFLVFASIVLSVSSQLFAQRFNSVVFNKLPQDYQLYPRDGQSEGIVPISGVVEVTGYSYVSVQVFRNDTFVKYLKASLTYDNKGVGSFAMETRIKAELAQYSFKVFACKTIDSTLIVTRKNVVSGDVFIVDGQSNSTGFFDEASTDPYCRTFGKITDILNTTPYNPADTLWALSNQQKYLTGVGTMGFEIQKQLSQKYGIPNCLINGGFHWSSSVNHAQRTENNPADLNTGYGRMLYRVQKAGLQNAVKSFIYRQGESEAYHEGSDWPGNFKKIRNNLKLDFPKLEQIYVFQIDIIYFPSTTGAELREYQRRLPELYPDVQSLATVGTKQFDGLHYGPEGYRQNGLEVSRLIARDFYQLKDTVNINSPSLKMAFYTSQEQKQLILVFDEGQQLVYPEPYKVNDQLTLLMKDFIYLNGFPAGITTANADGNRIILDFANSQNASRFDYLPPYTLETNYFYPYNGPYLTNKLGMRAFTVNNFSIANGLNSSNLTSSVNPFANAVLSWTEVNGATGYTLERKLAGENDYTIAGKFSASSRSFEDKTSSFPGKISYRLKAGNSISESSAYAYAEVEIPVILGLEESGKDLFEVFPNPVVNRENVTIHFLTPVKGSILLINSLGQILKRQTVNRQPEADLFLQDLPSGTYFIQLQTEDKSLTKKLPVVR

SEQ ID NO: 438 - protein, 981 aa, unknown
  environmental sample
MIEHPFSLLRNLARTGNDTHEHGDETLSFINAMEKLNIHSVFDIVRRSKSAFVHELSRISDAGAALAYENARCYATQIVRLYRNQLLSSGRTQQLTQRTGVRSLVDIGPGFPNLFKENWDLFCKVGAIEAKDSPVAYLTSLYRFALEQLEGSVAEPSRIKLDERRPDLKDLLIDHQSTFTPVPTLHIVNQVLSKAINAYVGTVPEDKGKTIYQLVAEKQHPFQFPYNFHFQQISLGLDGKKPTLGELSYRVSLEVPTTSRYGSDYGKVQHSSAIAQVLMSGAGPEQQAIVLEPALSSQANADTSADLTRQFFKTKYNVDYVDDASNPLNNLNAFLEKTGLDSDGVEALLAIGNHTAYASPNILSAGHTTDEDSPREASLTAIKARFGAGYVNGPTTQPAMALNKDAYGIKRLVNTSVDRFDRLQRMIRLQRWTGIPFTALDTLVMAVVRSEGAVNPQMVLTVNTLRALGTYRYLNKRYGLAPDEFAAFVHQMPGEANDGRLPMFDRVFNNPALFDTPLVLDGSTLYLDQHSSQHVKARAQLSRALHLSSTHEGLRQLAIDVRELIGNAPTDFRLNLSMISSLYRQARIASMFGLTTAECRALIDLLGSLSFRKKVVSGQLDDTEPDVLDILMQLDWAVTWLEASDRDVTTLRRQAGWDMTETIVTQELTVQLEQLTNDARLAVLKGDQLASLDLPSKDDQNNTLNWWAILYYHLIDGFGLVTTQPLDEEPAVSIRRTLHERLSSIAIAEPLASEVEARLATFVLNGYRNQHRLVEELLLTLTGLPPDRCEPVIRWAGSDVSKFLAALLWDNGVIETLSMLIRYSEVSQQLGLSARALRTFLINPRWLYAGSEGQFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 439 - protein, 927 aa, unknown
  environmental sample
MQTDSSSLLAQLIDHTRPPAPGRDDFKTALRRLNINSVLDIVRLSEGAFAEQLKKYNDDDAHTAYLKAQSAVAQLERLFSEQQVSSGRPSLRDKRGFSADTSATYQALFKENWEQFCASSSIAAVDSPVAYLRALYLFALQLEQNAKGENTIKLSDRRADLKALLIDQHSVAGQVPMLSIINQTLLHNIAGATDAYTLLSKTWYPFSLPYHYHHQQCRLGLSGDKPMLGELNYRISRQLPLKDGTNTYGQVIGQNNEVQCLLSGLSPEQQTLLKSDWVAAQDAPTFYSKYFNWTAEKGPENVTDFLHHTQLDAEQLQALLAQQTQAARKSPNYKQDTRFTYGACYINGANAPAAAIRQDKGGPAKLDNVSLERFDRLQRMIRLQRWLGLPFAQLDTLLVSAMRCEGASNRALLITHNTLRALGVFCYLSKRYNLQAEEFAAWLHQLPVHASGERVSLFDQVFNRTGSALPPLYLDGKVFDATTEQQLCAGLGLQDTQDSLHLLITDKPATRTIETVSALYRQVRIARLFGLSVMECQQLAQLLGKTNVLTQLRTPTLRRKPRGATDFLDVLMNLEWASRWLKENGNSLPLFKHQLLLDRQVQDPAINLLVKAFNAYDQASLATQLNLLELPQQPKDEENRLPIVDWNTLIPQVLQNARSSTSIEQALDEVLSSVAISTDSKRNTVIKDQTKPKLLTLLNKVRDELWALYLRLKDIIHAVPHLPGNANGHQKYEHHRHFLRLYAPAAPPLRTLSYLILLLPHAVDVLQLPLSRHALDQFIINPHWLDSDYQASALLELTPHTLYLMQQFKHCIDRLGMTEGQVLDYFRQANTPPDSVAQNNSEETNEHLARFCGWSAGEINVFSHQLKPPRITSMDRLEWLLRCRHVSTETGLSATQLIAASQLKSDSTFAQWQDVGEALISAHTSLH

SEQ ID NO: 440 - protein, 926 aa, unknown
  environmental sample
MVERSNALHQHTPALQLVDPRGLPVGSIALCRTSSDIEPQILTSHASFDMAGRPVSCWDSRLWADRAPANLSVIHSLSGQVLASDSVDAGWRVSLAGEAGQALVVWDARGVVRRIGYDALLRPIEVFEDEHCVERLLYGGPDSTDHNQCGQLIRHDDPAGTRLDDAYGLSGNVIRQTRRFLHSADEPDWPESLTGRDALLEPGDGATTCWQYNPLSEITWQRDAQGNVQCLGYTVAGQLKDSRLQLNGQAEQVLVSAIQYDAQGRVVSETAGNGVISTALYAAEDGRLGELNTTRSNGQSLQDLRYDYDPVGNVIRVDDRALPAISKGQRIDSVSTYRYDTLYQLIEASGREWAVVNHGPVLPGFQSPADPSTLADYTQTYRYDAGGNLQQLTHTGTQSHSRTLVTARFSNRSLPVINGHIPDEAEIAAAFDANGNLLALQAGQNLSWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGSGTLELDGQAQRVSHERYYPFGGTSWWAGRNAIEASYKTVRYSGKERDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLDLRKGDETEIASALRGRRNVHISDLREEEFFRKFQKTPSYEIYKDLYGDDPRHYSAASDVLRYSLINHYGGIYSDTDDMFKRGVRDTDFITKPKRIFTMRPTDTPWNRDEIVINNNSFASPANNPVLSTLEKEIVDRYSVYRETGLGKVLSSTADVSDRMRIVSAVTGPKVFTEVLLKEGRGLRKLFSTMVNYHVKGEKLKNPKRYQAEAQKRMPLSNFIKMGGSHSWQ

SEQ ID NO: 441 - protein, 470 aa, unknown
  environmental sample
MMLRPSVLNRRRFLGLAALGGTGLALPTTSLAQHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVVEQQLQATAKAHPHDGGRHRNEPLASVYTLRSQLQISLGDMRDCWAYFDTARYPDAIQVRLDRELFSMLIGSYYDDRVPEPATVTLPVPPTGPIRSITLQGYVFVDGLTLSYAAGQGPDRVDAVHVGGAGGAFFSIDDIVERGHVRAVLVQHGYAVDRLGLEYGDGTLSGTVGNTGNQDPAARLAFPGHHLSSVIGFGTAAGYGGVLSGCMFGFQLDEPSAPVAFDRRVQDRLQRVWPSGLQAALRRSAQG

SEQ ID NO: 442 - protein, 419 aa, Photorhabdus Sp.
MQTENVLDIRTIVANEYAVKTSALEWDVTDIVKNAIIGGISFIPSVGPAISFLVGLFWPQSKENIWEGIVKQIERMIEESALKTIKGILAGDIAYIQERMATVADLLEKHPGSAEARNAFNNLAENIDGYHKKFNNFSDDVNYQILPMFSTTVMMQITYWVAGLERKEEIGLSDIDIEKVRGLVKKTVEQANSYINNIYDRELNDALNNSTADTVVNNVMSVHGHCRLHGIEYISIWDRLSETESVNNRIYVDVLSYSTFFDRQTAKARIQALTPEKDMTPPLKPALNGGKRRKINSLMGHIVRIGGAPRVGGLTVVFDDGSRHQLGTISGETASISLDSSRITSLEVWGNGAVDKAVFTLSDGRSLSFGEPGTSRYRKFYVGESHYISGIYLSSDYSPLVGQAANIAVSYQLINDDEK

SEQ ID NO: 443 - protein, 133 aa, Photorhabdus Sp.
MSRITIFIDSDEQKSEVYSNSTVPVRKELNTVFPLSELTISPGSSVEVFRIDTPIIPESRRSLRVVNTGLASHVTAKFYWSHSFTSEWFESGSIDVGLGEDKVLNVPNNSFYYSKFVIYNNSDKVAYITANLV

SEQ ID NO: 444 - protein, 302 aa, Segetibacter Sp.
MSLQYLDKRLIGAIIVDAWQNHFNTEMDPADGQWFTNGPGNNGGLYGILTDTLASELKFLPDQQVFTMNKIAAATSTADNRNGLTPHQTVSLTYEYQNSTTVTHSTTNTITVGTGVEIKSSAEFLGTGAEVTVSFNTEYSYSWTEERSESVSETKTFGQEVSTDIPSGLVYQVTLLADKANIRVPFYADIILTGQSVANFASPVNGQKTWAIDAGTLCEWINQYGSAGNESYRYMKDASNPKQGFIRLEGNLTATQTLNFTALTSDITDSFTATAQPALMRELNNSELEKLESKAIKKVALG

SEQ ID NO: 445 - protein, 454 aa, unknown
  environmental sample
MQQPKVWSEYGIEGCIYYEDKYGYLSLKTDGNPSEHNWYFPSDGTSNNRWDFIQWRAGIFTDPKQWGDSGAKGDIYYSKEYLSFFILQKNGNPSEHNWYFPSDGTSNNRWDFIQWRAGIFTDPKQWGDSGAKGDIYYSKEYLSFFILQKNGNPSEHNWYFPTDGNDNAQWIVKGNIKKQEWIKYINDERPINQISLPGTHDSATYTIGSAAIVSSYAKTQDDSIFEQLESGIRFIDARCRHISDVFAMHNGNIYLNINFGTILNDCYRFLEQHPDEFILMSVKKEHTEENNTRSFDKTFEIKYYDSSRWFVEDRIPKLKEVRGKIVLLRRFSGGSLGVNAASWPDNQTFNTENKIHVQDEYNQHNEAKKWHAIKNAWDFGVDNSKKGWLVLNFTSIAADTFTSIRSYALDKNPEMAKYISGTKANGGVVISDFPKIGKIAENVIITNFGEVEKF

SEQ ID NO: 446 - protein, 401 aa, Acinetobacter Sp.
MDIPNSFKFMLSCVTFTIAICCSNLVFAGAAEKWQYDVIPDKSKNIINVTAKNITQNAANDLTYKVKVVPNSSIVGRTVLRRLFSRNVAAFATVAGIELTLKSLGYSLDYDSQTVYREIKTDSDIGWIDLNGIWHNDPNKWGKAWVDTYNSNGATPKAVFNRVELDEKNTAYLWVDRTYGAETYTSNVTSSASQPNPNPQPTPNVREILNPEAIGDIVLGNPPKPVNFSPELPLPSYPPVYSPELSNIFKPVPDVNYPNDLDPAPNQVIDLLDKSQPSSSDQIITTTPTPDGSSSLLPNFCDWATPICSFIDWFKDDSAIPEPEKYEVKEFDKSKLPTAPQFSFNGQCPAPKIFNLNLGLASTQISLPYDYFCSFATDVRPFVILAAWLHACFIFAGFVRS

SEQ ID NO: 447 - protein, 1093 aa, Bacillus Sp.
MADMWVLDRYDNPLAILSSDAEDDACTFHSDQFLEKLNQGTEFSFSCDARHEDSLHVNKLNQVVFRDEDGFFRLFKIREIDRGNGDNGAEKIAHCEPAEMELLEAIVEDVRPTGKTQQYALDRVLEGTRWKGNVTAQTGTQSTNFYHISAYEAITKIIEVWGGELRFTVNFDEENNKIIERVVNIEQRRGNDEGDRFEVGYNVESITVTEMAYPVSALYGWGGSVETENGGDSRYIDFADVEWKVSNGDPADKPKGQKWIELPGAKEKYGYKKSDGAFINSFGQWQDENITDPKELLQKTYEHLRDTASKPQATYELKVIPTDHISLGDTRTAIDDTQADPIQIQSRVIALGYSISNPAGTKTVEMGEFLEIYQPDRRLDDLEDKVKNIDRNVQVTDGSFPDIIPKVPSNVTIKGLFSGTSITWDYDPSSYIAAYEVYGSQTTGFTPSIENRLWRGKQSGFLHENAGVDNVWYYRIRAVNYHGKASEFTAEFSAKTQRIMTDDILFGAVTADKLANLAVTADAISRNFEEANILPGSLLRLSDILRVDSRVIVNEVNGFNELSVTKDTTEYTSFGFTTGGRNSLKLTKGETYTLSFELKRETLNDFSYIQVRSKSGTQYNLTNNFTDLSSYPTDEFVRFDLPFVSPATLTDGRVCLGGRTQNLTDSANFTIRKVQIRRGNVRMSFGFSPYDTQLTDGAVTSAIIADAAITSAKVAEAAIGTAAIQNAAIARAHLQEAIIDTVHIADAAITSAKIKELSADLITSGTIKAINITGSLIRGGKFQALNTNSNFDSYFDGDKLYQYKMNSKSQYTKLDISSSLIYQEAGADYSIDGSKPEIWRSVSIGNGKVSVKGSGEFTNASNMAVVEMYGDFNGDGDGIGKFVIRNETNTTVPSDIFTLEGGYDPIDVNDRYNANYTNRATITGSSTLLSLQPLNFETVVNGGIRMKSSKRTVFEGAPVELPKKSTIMPGDDQFTTQEKIVGGNVTSLVTDIHGALQNNLMICITQIDVTLGASGGAYAYAYNWYNMVDGNYQGAENIFAVMATPYGKNANNVTVGIMSQSSEKFAVHVRGTGATDVAATTVTIRLAIFYEKK

SEQ ID NO: 448 - protein, 986 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDMLTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPDPKWIAESDNEQGGYYQDSFVPTYRMILRFVPR

SEQ ID NO: 449 - protein, 1004 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 450 - protein, 185 aa, Providencia Sp.
MAVYFVTGKLGSGKTLSAVYKIRDYLMKGRKVATNLNISFTGMFGYRAKNINLVRVPDKPTAFDLDAIGRGNTSYNEDLNGLLVLDECGTWFNSRSWADKSRQDLINWIAHARKLGWDVLFLVQSLQVVDKQSRLMFAEHVVYCRRMDRLKIPYIHWILQIITLGQFRLPKIHLAIVKYGDSPPH

SEQ ID NO: 451 - protein, 923 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQAPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVTETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVECRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYTALQQMRPSNNIETALDHVLSSVQISTAPARTTQLINQAKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPANMLIKASELKADSAFADWKSVGEAITSAYP

SEQ ID NO: 452 - protein, 802 aa, Stenotrophomonas Sp.
MRNASERTDILSESELLAWLRVKPRTLEWDALLVYDRTRANRLLLQEYIRRLHSESFLPPITRLINHVPGAHWEYIADQLLAAPRLSFEDSTITSSMANLTMHVMGGTQWSIQKQPNGPRRIVKIEVIDTLQGPKLTGHVFLSEVEGSVTEDGKVQINLHEAVDLQFTYADTTIMREQAGDYFQRLFEHLPEEQQVFVLNELGPVDENDFLDPHTFMFRIFRAKDAQYRDSPTWGEGAILAFINGKGNQSNQGPISDVGWVYPIPEGQSVTLLVSNRFLIRNLLESGIRDMADGNVIIEVENPDNPSAPAGTMRAGGFRKQDLLQSVPDDYGEDPFFDSVRYTATFPLNSQGSPPGEFVVRHENERIIMEWSGSTVNSTPQRMPTLDLQWQGKSCRITLLAEWHFKRAYVFTAGQYGARLEVDRAQSIDEAKVTPLTVSPEYGNEVMDHWLPLAQFTTISLLLNSFDKVALPTREIDLFRLHSLLFQSEHSLVLESGHYPTDLAMFGQLSPQETYFAVEPQESLMAPGAKQQMTGVDGAVWKVKGVPGFDDGAGSITPTGLYTAPAASEIAGHHTIVVVTATHGRQTSSALVRVLKRSVVCNPQVVVVGMGGQQVKFSAGSLAEGALTWALKSDSGATLKEIPLDNDVPFEPGDHFYTSGPAPQRHADLLPDNFIGIDEVIVTHDASKATTTSYVLTLLLDGMAEVRVIPGSMTATQVKLEMRTSDPEPIPEPDWDVVLGGGSVDADGQYTADLAAALPFAVVRGFKDYGFPGVPQFCGYILLSVPLVDLEALKEHDWDTDT

SEQ ID NO: 453 - protein, 578 aa, unknown
  environmental sample
MATANDIKLTGNPEIDQFFSGGIRLLPTEGNTYYWHMPNEVHSSVTTVEPITNELAKNMVREALQQISNVININFQEVNYSVSNTGGFDILSGTDLYPMEGGISLNSEQSDATIQFLNNYSDTNTSISSKARTITMHEVLHLLGFDDGPISRNPDYTTVDSVMSYNSLIDDRYGEKVRSYVYDENGSQMDGTSWATTDTLGIYDIQAIQSIYGANYNYNAGNTVYKYTPETLKNFQTIWDGGGIDTIDASEFILGVELNLNDGTRSNLFIKDYSWNGYEYDGTRAIGIAYGANIENAIGGQGNDVIYGNELNNVISGNDGNDILYGADGDDTLDGGSGTNTLYGGSGNDRLISKGSDTLYGGDGNDRYEISGTDFRIIEEQNGGFDTIDIYSFDAATYVMPEHVENIRLNTGWDINSNLTGNDLDNSIHGNFGNNILIGGKGNDSLVGYRGSDTYIFSKGDGRDTIDEYNNNNVPATDTDILLFNDISIDQLWFSKYSSWGDESLLINVLGTTDQVTVYGWYTNNAKLEQIKTQDGVTLSIDQIESLVDIMANQTMPLANNSTIIDDYLMVQTSMIMG

SEQ ID NO: 454 - protein, 491 aa, unknown
  environmental sample
MDTKNDNTVQGIPVKRKMKIPLDSAVPSGYPIPKLKAQLTDLGLTCEETSEEQLQQYKDDVMKDFKTGSRTIYGLYRGKPKANFYTSDLLGADGRFRVNGNEFMNALGYTKLAENGSWTLDDDAEGYRAELCTIIYEDNFEFLKTDYPFDFNGQKNSQSQTINEPTGKAIESTFSSMAKAVVGVVQSGISSDDLETLVSTIIDKNQSSNIHDYEMNDVLIAYLVNDYDPVKQEAVAVGALSISYYIHIKDYKDKGDNKDGRYNDAIIQVTARFVSYSDLEYMERDLKRIETRTKALFEVQEQSRYLVKGNCFTLLDSSGGIPPKTTKLVVYDKKPAANATTFLTGLPLLNKGNYADVMIFFCPDLVNVGCLDNTDSDVTSSYSKSVTIGFQQTEGISISTETSMELSIEIVKVGFKLGVSMTMSNTWSKSETETVGYQLPGRKMAYLYQGQMESIILRYDPSKQAYEYVNSSLNKFLTNAVKTTEKPIILE

SEQ ID NO: 455 - protein, 388 aa, unknown
  environmental sample
MPRLHLLLTGAILNSEANNQLKDSCLQTATAGLVVQTYCNQVAIQPAFNLPDSVKTKMPDVDAYLTAAQTNANHYLRNVQPRIIAVIADVGGYSSEFGSFYGLIDQKIQQWKTGSDDGKKDALLLLNQLEVDLQGKLSNVKGVQSDINSFQTMVNLDTSHFNEAFQSAQVIIGGNQGAIAAYNEQIGSLNKQIAGASAGVGLSGLSIIGGGILVCVGVFASSVTGGLATGLVVGGAALVVVGAGGLVASSIALVNLINAKANLIQQKVALEQNLQALTTFKSSISDLKDSAASAAQQLTNMHNAWSFLGRNLGEVVTSVRNAQTYSELPIVVQAYLNTAASQWEDVKGSVKTIERQMTGVSTSTLKDGKGNPAQLTKQSIINYVSHAA

SEQ ID NO: 456 - protein, 460 aa, unknown
  environmental sample
MLKLIPTILLSLMVTAQAQASQCSGEPLAQNMLCAPDEGIVPDTGADLSAQIPALLEKSSAEKKGIFFPAGEYLFSQDVVMTSWNTLQGSTQGTVFRGISPTGSAILVGDETYTNTVTDLTVSHIIFDNARVGFYGRKNRINLAYNAFVNTRTATNTGQLTASTNPYLIRGNIFMRGNGYPGVGLNTYGNAPGLIIEHNFLGSPDKMSKAAPWLLDDTKALLETMLTLREQGKLAFDDTQDKFVAGWYSTSNLRDGTFRNNFFSGSTNSKLYNPDTGAEDITRDHAVYIKQYDKVVVTQNYFGGWPEDASGQLKFRNANGLVFAANYLDNISFNARPYDNTEPAWWIMTNTFIFNNYVKNGIINYWQNFYDTADKFITVTDYLVFSNVFDVENKNDCLVSGQSISLSEEFYESNNRFSDGTDGVVTCGVMNPLSLDDITARLPDYASELLNLQPLKPGAD

SEQ ID NO: 457 - protein, 265 aa, unknown
  environmental sample
MLVSMEKYPADSILKDYPLGIYDNIGINLVKKWERALVSFHVRKPFHRFEVETVGTGFLFENESVVGIYTASHVIKQIMDDKTRTIRINDSFYLLSNVNVFYEDTQDYAIVELPKEAMNGQRIVAFPLAQRNNLNLTKSFMIFGYPANKNVLRLGKQHLFNTLNIFRNDFKYDTETEDIFFEFNKKDKYIYEPDSSFKSLPALNGMSGSPIVQIVVNKNTEALTLRVIGIFKIHRHNNKEKYLIGSTLTNFADEINTMISLGVLT

SEQ ID NO: 458 - protein, 1269 aa, unknown
  environmental sample
MAIVDFYGNSVRLGSGVSRVVNKSALVGGVATGTAAAEAFNINGAFTLAGGAGDDRYYSVSRDSKIVEKAGEGIDTVYVISNYVMPGHIENLEIGYASGVIGNGLANYIKGSLLSQSIDGGAGNDILTGGGGGDAFVFRAGSGYDMITDFHTGPTADVRIAPETVRLAGYEQFSSFAQIKAAMTQVGSDVVLRLDADNAIKFAGTTVSAFTKDNFELRFDSTQLKASFSDDFNALSLWDGLAGGTWRSDYGWGGDRNATMARTLAGTGEKQLYVDSGLLSKETGQAMGLDPFSVKNGVLTIHAAPTAADLVDDLSGYKYTSGLLSTRNSFTQTYGYFEARMEVPAGKGVWPAFWLYTTGSSGSELDVMESHGGDQYGVTTHDLSTGTDVPLTGTVFVPDLSEGFHTYGVMWTSETVTWYLDGVAVRTIPTPPDMHGPMYMLVNLAIDANVQSDFVGADMQVDYVRAYTLEAAPAAVDRTAGNMISGNTVSGGGAIDYLSGTTGADKLVGVAGNDTYYVDHAGDRIVENANEGLDTVRTGIDWALGANLENLTMVGSAIRGTGNELNNVISGNALNNILSGGAGNDTIDGFAGADRMIGGTGNDIYVVDNVGDVVVELANEGVDVVTASVDYSLSANVENLTLTGTAIRATGNDVANILTGNELDNILAGGAGSDRLDGGKGADAMSGGRDGDTYIVDNVRDVVIEKANEGWDSIVSSVDYTLSANVEQLTLSGKAIRGTAGSAAAFLYGNELGNVLTGGAGADTIDGKAGNDRIIGGAGKDKLTGGAGADTFVFGANFGADTITDFRIGEDSIDWSALVPIYGAPKITNVGRNVVATFGTKANSITFTGLDAANLVAGHVFDALNPLGNPFPEPTDEPTDEPSAPVAPPVINYPTLTGTSGDDTHIVSVADTRIVEQVNGGIDTVMSSLDYILSANVENLRLTGSAISATGNELGNMLSGNTLDNILIGGAGHDQLIGLEGADIMRGGTGNDSYSVDNVGDSVAELANEGTDSVNSSADYTLTAHIENLALLGLAVRGTGNDLNNVITGNLQDNILSGGGGNDRLDGRLGADTMAGGTGDDSYIVDNARDLVAEAPGQGWDMIWSSVDYKTTANIEQLVLTGNAIRGTANATGSMVIGNELNNILTGGIGNDMLDGKAGNDTISGGGGNDRIIGGVGNDRMTGGGGLDTYLFASDFGKDVITDFDVRKDKIDLSVISALYRPTISEDNHNAVLHFDTNTITLLGVSVDDAQQNQFDWLSISLASPYDMA

SEQ ID NO: 459 - protein, 608 aa, unknown
  environmental sample
MATNTVISMPSQLFTASRSFKALANGKVYVGQVDTDPTIPSNQIQVYIENEDGSKVPVSQPLIINAAGFIVYGGQIVKIVADSNYSMAVYDAYGTQEFYFPDLLKYNPDQFIPELADPDSTVIIAGTEASKISYAATITANMNTVQELIAAHVPDNIGIVITAGYYDVFGKRDVWVRSTEMDLPSKTPIQLNKLSVTDANGSVWNLDISSGYIYIDSIGAKGDGTTDDWYHLELCFKNAEQGTNRIVKGNKSAYFFSKPILLKTGRHLEFNAKFGVDITYGGQLLSSTDAPSATTPIGSGFTSTFSDKQAQIVVAHKDGQFARYWSVKNCYIKNDSGTSSTFGIYCPFGNAFDLEHVWSIGGLTGFDARNIYTYSFSGCYFAAPVGITGTVGINVTPIQNGLGSGTSGTYERVGIVGYKYSWIFTEMNYTTLTSCYSEDTRTRYALFLTRCNGININTYGIENLTVVSGDGRLAAIADSQISINALQASYNINLSGVSAITVTGNSQVTINDVFIVAVGSPYVPLQTDNTSRVRMFGFKSTGPTPLVNITGLQTVIYGDQGRTECAKFPGNWNGGFLRIGDVRLWDDGTGLRIKRGTDPANVSDGTAL

SEQ ID NO: 460 - protein, 171 aa, unknown
  environmental sample
MSLTPGVICMFTGGTIPDGWLLCDGKNNTPNLIDRFILGASSADTNIISETGISGSHPKKYFTNTTNGSLITASVTIAPHTLTIAEVPSHTHKIVDYEGDYLRNADGGSRSGSDRYPVSTGTKQPDLTTTSVGGGGSHSHNGSLTNQSSHSHGININMPYYTLAFIMYVGV

SEQ ID NO: 461 - protein, 144 aa, unknown
  environmental sample
MENRLMKKISLIISSILLFTFSNHSYSTALNPNNSLEKQCEKEGGGSYFIKNAHITFMNATVMWNPENSAGDWKVHNAINIKLKYNVENSTKEAWFGVFGENVARGSSAFGLSSFAQAMFLLKAPVDVCVKGKYLRGIENNTAS

SEQ ID NO: 462 - protein, 439 aa, Bacillus Sp.
MKSKIMAGFLITSIVTGATIPINTLATPIVQAETKQDNIDISSALRKIGAHSKLTQTFIDGALASPNVQLEEVPSLNTTQFLIKQDMKEWSSELYPKLILLNSKSKGFVTKFNSYYPTLKGFIDNGEDKEGVTDRLEVLQDMTITNQESVQRQINELTDLKLQVDKKLKNLDTDVIKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDGEIELMKHYKEDLGLINNSITKLSTEVDANNTQSQKDTLRRLKSVTTQLEEQVYKF

SEQ ID NO: 463 - protein, 409 aa, Bacillus Sp.
MMKFPFKVITLATLATVITATNGSTIHALAQEQTAQEHKIENYALGPDGLKKALAETGSHILVMDLYAKTMIKQPNVNLSNIDLGSGGGELIKNIHLNQELSRINANYWLDTAKPNIQKTARNIVNYDEQFQNYYDTLVDTVKKKDKVSLKEGIGDLIDTIHTNSNDVTEVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWNDIHKDAEFISKDIAFKQEKTN

SEQ ID NO: 464 - protein, 377 aa, Bacillus Sp.
MNNNFPYKLLAVSTFLTLTTTTVVSPVAAFASESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQVRHFKQVESDGIITVSVPSIPTWIAGGVMIGVARDNLGTLEPLLAQLRQTIDYKITLNRVVGVAYNNIAEMQNAIGLAINALTYMSAQWHDLDSQYSGVLNHIEKASQKADQNKFKFLKPNLNAGKDSWKTLRADAFTLKEGIKTLKMDPVSSKK

SEQ ID NO: 465 - protein, 210 aa, Paenibacillus Sp.
MYLMGIDGTMGTGKTLCMSVLAQHFRQQSGCTLYSNYELKHSKLITNFEMFLDVAQQPSSIICLDEAHTDLDSRSVNTNVAKYLTHMVFYLRKLRCTLMFTSPDIANIDIRLRLIMNVYCKAKKNKNYFNYSLWNAQDNKPLRSLRVNQRKIFAIGHQIYDTNGMVVPMDFPQTKEGYLDILNLLKKVSNQYYAQASSDAGQQATGADAV

SEQ ID NO: 466 - protein, 310 aa, Photorhabdus Sp.
MFKNDIREKAVKFGKSKTSDQGLLDALHLELPDVKAVMSAYKRQLPEFDDFNRKTQLILNASKEFGQLKPAKQRKFSKPGLKESGVSGGNFIYSKKSLQDFAAHAGYVHNDHYGDEFVNLKDNNRNLADERLFPGISLIKRPKLSIVKDQEQWNMQQSDEAEAYKITDIEAFISGIREMYGEVNPLHPVIESLIRNHIVNNHYILPTMAGIAGLHAEVQALNNLLTLEDERAGKAIGSRKMGEYMRDILKSSIFTQRLTTKQAGDDFAACHNCSGILSSPVNVITGKVESAGSNFSSTLSRYKTSQESPI

SEQ ID NO: 467 - protein, 359 aa, Xenorhabdus Sp.
MILKNENGITDGNSVVTAHTDDKASAQWVNVTDVCVNVVSVSGQAPLLYANGLNMIAVRVYMTSQDINEKTIDDIDVNELVGAVTLIDYDTGVPFTKIDHPPSLNHITPGGTYCTVANKYLSGSNFINPGISGYGKRYITLYFAYNGTSSTSVRIGCKIKPTYPDKGADGRYVYNEVVNSINGDTHCPTTPIKVTVKKFKDSDVTESHLYSANVSTGKSPNRDIFRYYIKFSDGVITHVDLPTSSQPGAPTGYFHYKQTGNYKDFCCFTDDKFDVDPSAKWTTPTFKIDNSWSDSVTFYNHEEDGVCIFLYRFWYGALWSYQEWNLGAIFTLYDEYGNACKISAIRDEPNDKIKFSVVN

SEQ ID NO: 468 - protein, 1654 aa, Xenorhabdus Sp.
MNRDNDSNFFTQAGSFTSAISGGVDPRTGLYNLSITLGHINGNNQMGPQFPITLSYSPQSQGNMGFGTGVSLGVSTYDTSSGRLSLSTGEQYQTDENTSSVTVKQKKLDNFKFEKHGGESYRVTHKTGDVEILRGEDYGSSLKLPVRMINAAGHSLSLATDNNNRLISVSDESSPLLWVAYDDRVTLTFYPGTQEKYSVILQTNNDLLTTITRRTTGEPDLVWHIQYEDTGFWGQWATAMTSPSGLQDTVIYRCDGYTHRFPDSAPQSLRNNPMPYVTKRTLAPGAGQPIQVSVYSYSDYNYLGYDSGVDWEATQDNLYNCLDNYIYSSVETQGVGIASKTITREYNSYHLQVSEETSSGSNSVLKTTEYYAKLGTPFENQPEQFQLPRTITTMWSEGSTGLKRTETVITAFNESGNPVSQTDADGTVTQWEYYPANGSDTDCPPEPNGFTRFMKSETVTPRKTAYSTPAHKTAYTYATFEHASTDVSALVMKATEKHFADDVLLKTISCQYGTKAANTAGVMTKKTTTYPDPTDNKREYTTTETVDFTDPGVNGNNIDAWVSAYTLTSHDGLTVTRSRTVSCMTGRLLESTDNKGNVTAYTYNSLGWLTKRVHVKDTAYEHTTTYEYTVDATSGVFYATTTDPSGNKVRHGLDGMGRLLHIKKNDVDMDSKNSEPEFLMQQQTRDALGRSLTGSTHDYQQAANKNNPTQTVTQTQRYDNWGLVSESVSSEGVTTYTETVLVLPPTGTNCIWQLRSWQSGGTDTSGITVTTLDDNHNSVKTELYPKNAQVGKNTPYSVTYSEYDGWNQLRSQTDELGQTTTYKYDDWGRPTITTLPDNTQTHRAYVAFSSAKLPVSISVLDSNNIPVPGVGGTQTFDGLGRLKSTIIGGRHARYSYQFAYQRHPTVIYNEAGNQEVYTYINALGEAPESLRASGVDINVSQDWTYNPVTAAMMTATEDKDTENQHSLRYGYATSGQQTSVTVEKEGDIKEKSTNLMARTIGGTATTVRDYAGGTQTLTLDILGRATALDDADVSSTLTYDGLGQVTQWTVTSKKNHYTKTTTLTLDEYGRETQRTIETWDARNTLKDTLTVVQVWSKKHQVTHRTTTQTTAGKTVTLRDESYDFAPERGWLMRYTVSGSTPPQDETGKALSRQDFTYDSVTSNMTTKSVTYTDDTTTFTMYLFENKDDQCQLTGIRTDTGTTTSLKYDDAGRLTQDEYGRMLSYDALGRLCKVTLNGSTLTRYRYDAGNQLSGQTVGDTTTRYYYGNSTLAYMEDDATPKNAALLTPHAQVRTGKNAGIWLTSSDMAESVLSVTDGTTQENYAYTPYGARNGASSNDEAIAVTGYNGERLDGTLNQYHLGNGYRAYNPVLQRFTCPDSLSPFGDGGINPYIYCEGDPVNRTDPTGHLFTEIALAARAAWKAIRDSVLVRKVTDAAGGIWHNGKTMTDSLFGKRPPKNSLGRSFRDGDTAAGSRKEPRLQKEVDYKVTEASRSPMFKFNDNIRKNPEQLWSLHEDNGKYIYNSHTKVNGYGVEKAYVNLKKISNKPIDIISGSHGGNLGEGNWVEIFGPNAKREGVIRNPSYLEHKFLMQDLATLKKNKGLTDRVYNIKNLDRNELNNILRNPNTNVILGYCYSANDNYMASVDNRISSLIFGWR

SEQ ID NO: 469 - protein, 906 aa, Xenorhabdus Sp.
MDKFNSPVARGTCYFLIYLTGIYPLNSAIAGGITPDNPKTQVHNNGNVPVVNIAAPNNAGISHNTYKEFNTGIQGAILNNATQAVKSQLAGQISANANLHGKAAELIINEVTGSSRSELLGQLEVAGQKANVMIANPNGITCDGCGFINTSGAIITTGKPQFDTQGALEALKVTKGQITIGGKGLNGQSTDYVDIISRATELNGKIQAKNLAFTQGANQISFKDGTAKTIAGEGNRPQLAVDTKALGGMYANKIRLVATENGVGVNLKNITSHQQDITLSANGKMELGNIKAKTDLNAGAKEINIGPNSPVQAERDIVLASSKLSNKSSVTAGQDMRIYGDTISNAGAQALLQANKNMWIQKNAEGGKNELVENKSGTIKTNSGDLIIRTQNLVNEKENVQVTKTNHQINSNAGYGDYPKFKFDFNKPILIDSRHKDIKLEHADFVSNVDSKQAVIESGHDAYLYGETLTNKNSSISAKNNLILTGTHLKNSGVSFGLLEKYKEYFRSENRENILNRDILIWKNNSVSQSILSAKNSLVADFKESISIKNELPSEANNINQVIYGNNYAALNAKNILLHAKDVYLSNEIKADKDVSIIADNAVKTSLAVLNAGENISIAARYDINLLDSNLKSKNISLISHDGNVNVKNSLRAFYPDNTRLLSKLDASADLSISTGKDIYIKDTLFVSKSKNIAFNANKDITIEHTDDLLNHHNPIQQLSTDQEAKLFDSLSPTAKLDSSGSILINSGGNLSLNRVNLDADKDIDLYAGYNFNQYSKEFEPNHFSVSTVTKALKLQTHIRSGNNLLINAQHDITLEGSDISTQGSTNLLAGNSINLLGIPYFFENNGVEVLKYALPVIAIPPNKNIITTIKANKDINLISGAYYHPSRSPNNIHQDHLIPFNEIAQ

SEQ ID NO: 470 - protein, 488 aa, unknown
  environmental sample
MMSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGK

SEQ ID NO: 471 - protein, 506 aa, unknown
  environmental sample
MIIKNKMVKRLISTFLMSLLLASMMLVIGAGKVYAQGSVSSTSLQVSADSSDYYIIGSDFYNHFVRPTTVDLAKNKVVYNKQILTVYNGRIDKWKMSFLNQDSSGKSWFKFLSYPEATKGDIKITYTTDGINYSDSKPSLEQLKGYMVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKE

SEQ ID NO: 472 - protein, 95 aa, unknown
  environmental sample
MRYDDYHEAWEMNPRKLSTEEIENPGKVIEDFFRVSHLPGMRSSLWELMKTMVTGTFSNLKSRERARLIYFYEQVEKLIEAAHVLHEKNKGLSPS

SEQ ID NO: 473 - protein, 1381 aa, unknown
  environmental sample
MPYNNASSGFGRSSLVQSILDIYLAVEQTERWKQAVKTVGQEKKLDSNWMPVIQNVKSIGGGKYSVQFINKQNPDNNPQWIETNDATFDNFKVFFNDQAKDLGAFFQVDSVTGTVSTQIEGGTVSAGVGIGSNKADLVKAVVEWVSSGELYDKSGNPDLDTAVGVQSYLNLAQYGHGIATEAAEVISAIRPALSNGGAVAREVSESLVSTVVKTTATEGLGIAMNIVNVVLDGIVLANTSSSVERASVTTTLVFDVVGTASSLLALGLGIAGASTAASILGAIALPIAGLAAGIPTLVALYAQRSENARKAAEPFGIIADGYKANADGTRGMIYQAADQYQKIPSALKPKGGAVITEIDLVNKKLKFGSQYLYQVNPDHKGAGHTKVNNRDSFFAGPDIGRASAKAKQLPRLSIRQGLGCPETMDLKYSDVEVIVLPRDIEMTFDYEHAIVAPLWQENESSPGINALRQIESHPDIYEKFYYDYWATSDYAISQFYPEYKATTVTVKLDKAKRSVVIPQVADIERSNLTYRLQGNGGTYIVALSEQEIDIRIQASDNPDERWIFNIDAIGLRTYSTWLRYPDCWTVTFHDDGFTIGQTRTEDKSLQITAAQPQRVKFEGKMPNYVVLSDNIGHIFIVNLKERNMSLMLNITKIQQTDSNKIGSMDMNSDSLLYRAYVSYRYLKQAAQSGNANAQVETGILKSVPLTNADNIAIVFEEPDSRLHYMGICDLKNFALVAHCKDQTRDNPPQTITQMQVDRYGELSTMRDRDRPDKLAFKGSFENVWTANNEIFFTQKIPQQESGTNSVIQYCMYRGEGFCFIDAINANARLMDQILAVPLSELRTSKVDRLLDQAGLILQMQPRPEVNRVDYVYGKDTYTIVGQNSQGVSYQIKVHKDAEPSLSWEEGEIQYQILSGYALQLTGTSANNTIALTPLSKYPNLKRAILFGQEGTDTYYVDRAILHYQAIFVLNYAKDTNQDVLRLRGFRTSDFSYIQQGEDIILTHKQSGNWLNLVGVSSSNPTANRYQHLQLQFDDVTFAVTEVASRLSLGTADVTTIFMNLEDITFEKQEDNLIVSQNNKTDSTAYSNFYTTYTSLNGFQVKFPSTTTGNMLSLNAQELAALGKYNVKGQTVVTAGSAKQFVDRMLAEIGNVTIYEVSSGNVSRQGQDLVINGQVCNKFFERPTQSRQIKIPYLLNDGAFIQAGYDLVFMRVKYDHNWGMDLWTYTGETSPACRLSYFYDSYIEPNPNQGYVTGRLVQTFTELNNNPYRWGTTHQLQVEKGNLNNLLEQMSVQIPTQDGKTVILSYDALKKLGQESAKVLASSTSYDQRSNTFTFGSYSNTDALIGFRISLYFDPQTNEVVADKQVDKYTRNSYLRVPAVII

SEQ ID NO: 474 - protein, 292 aa, unknown
  environmental sample
MTVAGDRLTNFPDSEWVGQRESISWQWQSREGLPYLTCSLLDRWSHGFFTRDFSPRGPIDLTEVLAPGAKVYRLQQVHGNAVLKTTELSPVVAPDSETAAPSYAEADGLVAGRELEALWVCSADCVPVLIADDRTGLVAAVHAGWRGTAAKILPEAIAQLVAQGSQLENLKIAMGPAIAGKVYQVSVEVAAELGATIAPKSAVSATADGICEFLHQLPETPVLADPEPGKVRFDVRLCNALQLQQLGIDLSQVAIAPFCTYSDSARFFSYRRDRLKKVQWSGIVSAGGTSSL

SEQ ID NO: 475 - protein, 463 aa, unknown
  environmental sample
MQPWSPTPHTVNLSGMSEEYYFIISKAHDPSGQPLVLSANSDAHNTRVIVAVQSYQDDKQLWAKRLRSSGDTNTFALVNKARGTILARESANNGAAIVLVSIGNIQTNDLAVWQHDNVADQYNALCSVENWEQKLNIPGNGPYRAGTGVISHWWDRGSINELFRFFSASRALKLKRIVWDMHNGSFEELTPVVALQKTLHNNSNAEQQTTLEYSGEKSKTTKYGVEHGVEVGLSFTISAEVPSVAKMSLTLSTKYNHKVTFNKEETEKETIKLSFPVKVAKNTQMTAKVIMLHAKMDIPFNAVFDMAFEDGTSVEVVEPGVFSEVSCYDIIASYDESTTTTGGGIAPVGQDNWRWCRKCQGLFFAGHAHACPAGDDHDPKGSSNYVLQSTANTKEGQDNWRWCRKCGGMFFAGNGEPAGKQFGWAWCSKCQGLHFTGSGAGVCPAGGGHLHAGSSDYGLKFLS

SEQ ID NO: 476 - protein, 1243 aa, unknown
  environmental sample
MAKVFHLDSVSHDTGVVITDLGLQANEHDVETLDFRAGDETPIDPQHRQRQAQLEVVDKLYGPLHIGSVTVTRSALDALGAITDGQPLNGDNTFFRSPHRVFVDTLQFNPVDIQACINRTVDANDYRLPTLLFEIASQRPPTARPLLREIPDIPAEPGDYRGSLERLLNAAQKLNTSVLTQRTLSWVNKTKSNLLIPTGLGLQAFGIYSGLRGLQDAIRNKDTYQTAFNGASVTAELASIGLEAAITRQAMQMLKAGQSALGSFAKTSFALRLGRASGLIASVLTLPFDIIAAVDSLKAAANGRDATDHYVNAALSMTSAAMTVTIGVAALAGFTSAGPVGLAAGLILAVGSQIWGAIREVDEIDDYIELTVHERLRTGWFAFWMISPDDDIQQRYTTAKTTAEHTRQLRATALKLLQGTLRDSTEAIVNGKFNVELEAVTYNTWNWWTGERYQATRVRPTIKDSDDTIDARDGVTVDTPGAVLGTSAEHKGIHWHIGGGNDTISGVEKKPNVFHYGAGVKKLTGGEKDDVFIFEGSPQTLRTNPPLPPNRLVGGKGNDTIILSGRTKGPQEQLGYHVDLEAGHLSIIIQEQAKVHYPHAVLESIEHVEIQEGRTNVIRGTAGSNIIKSRGNDSIEAGAGDDQIFLLGADNRDADGGPGNDVYAIAHKPGSVSISEDGIDNSVIALDWRADLIEGWKIEGDNLVVTSGFDADDWQLREVIIKKAYRPVDNKRHIRNNKLTFVTKDGYHLVPDLPDTIEQSLPLDIEAVITQQGTPRSPIILNNQKTHRVAHDKDTSYYLSRLTASTTLQVIQRSDFTTTVHLDYASAELTRIEAHYNVQVTHDDDDWNTVKYGECGLTLYFGAHQVALKNLASSDERYTAQNTRTKRRAFSALGSNHLVTLIMNDGVSYRLVQPTPDYGLLLDETFIGQSSVGWKSDVSLPLTATRKKHMHLAPSDKSPYYMRNRATCAQLTSPSEQTGIEVLIGEGATYLVHLSPDMTLRLSTPGALAGAKPRLPNASTWELDATHLGTVEINLSANLLQIGTTIIHLPTYEAEDLVDKIRVITAQGIVYAVDTLFERVYVEALDARYFTFPLDPSAAWPSELSALATRDLQVLNIALKDGARGGLRYSLETRKWTLETDKTRLIESQDLRKTNLCDHHLNFYRDLASEGLGQNPPTDDGALRVLREKCVALAESLTLGNSKFLSQTLTLSLAFGMTAPQLSRLLSLYGSLPTLFTSPPIHM

SEQ ID NO: 477 - protein, 444 aa, unknown
  environmental sample
MSFELVIGKVGGGKSLYAMHRLIEELLEEGPEARLVVTNLAVKEPELNEYIQQKHPMANVPLSKRLHVIEDEQIERFYEIRRLKDGTPWEGGIFYLLDELHAKFNARNWIKIETAVTHYLSQHRKLGDDVWGTTHLPEHVDRQMRNLSYAFHMLRNDYRTVFRMPILGIAVKPRSCFVRKSYYFDPTKQRNPQPYEVATFQLDAQGIANTYDTAKGVGIKGKKADTARMQKKGLPLLPTMIAAGIAIWAVFQVPKLWMERAYKAHQEKLAAAAPSSHHGTTPAPTLFDQIAPSSLESVTVIPAKPVDDTPWPTMKQIATWPAQKVSAERKTYRGIVRSGRRLRVYLDDGRYLTEADILTVGKGVVVTRDGAVLFERVLKPGDIVQTPREGFQGPAPVSVPPPSPASPLQGTPAALAAPVVIEGPGVRPDPAKPFAGSGLDKPFG

SEQ ID NO: 478 - protein, 165 aa, unknown
  environmental sample
MRKIQILRVLLCILLFGTGDVHADSTVSVKGVVTSIPCTITQKNNGIVDFGDVLTTRIDGSSYKSYQLVLDLQCDTPVNADTMLNLSLSGTEAPFGEGLLATDKEGLGIQFRWGDQKYPVNSAVSFSYLNHDHSVYMSVTPAKDDSVELEGGAFTATATLTVDYQ

SEQ ID NO: 479 - protein, 1708 aa, unknown
  environmental sample
MKKTKILNSLMIIGLVLGSMNDAVVQAISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFVFWKRKMSKKSFDKQ

SEQ ID NO: 480 - protein, 836 aa, unknown
  environmental sample
MPTVPTYNSRQTVDQGLPAPQVSVQTNPDTFGAGLGEVGNRIAGIFAQEQHKANVAQTQDAVLQFQSFADDQFNNTDSGLYTKQGKNAVGQSEAVLNNIRGKADELAQQVPESMRRDFMQQINQAGQQYKRQASTYEIGQVRQYEEGQFKALQESTVTAAQGQYNDPQAFTSTVKQGFTAIDQFADAHGWSDEERANAKNQLKERSADGALSAAANQNYMDFIAANGEPGDYDGAMRVSGSTGDARGLRNNNPGNIEAGQNNWEGQAGSDGRFAKFVTPEHGIRALGKNLLAYGDKGYDTVNEIVNRWAPASDGNNTTAYVKALCEQLSVKPDDQLNLSDLNVLKKLSAGIVKHENGSIPYSDGQLDTGLRAALGLTSLESPKRYTGNVAFDAASTQAQASYLRQAKSLQNEARTQLKAQLTDVISDAKASYLKGVEYPNPPSQAQLISAYGYREGNQRFADLENQRVAGQYIGSFRNMPSSSITTYVADLKTQLGTGEGFAGRADAFDHVEAAAKQVINLRESNPYQAAMDMGVYKPIASTNPADITSEIKNRTAAIDQLKSLGINAPILSKEEAASISERVRGTTDVNQSISLLQSFGRGLQPQALRSVAASIAPDSAATAYSALILGTDDNQYNNRSPSIPYSQFVAYKPTMNKYEVAKTILQGDQLINPTKAQKDAGISAVKLPADDKLKQTFDDEIGNAFSHNPQARQMAWSIYKSAYAGLAYTSGDSDGVNTKSVDSDIAEKAIQMATGGVIKGFNGGDVVMPFGMDKSTFKDRYTAAAGDALKSAGLNPASQSNFVPVNVGDSQYRLVTGSGRWATDPKTGAPITVRVQ

SEQ ID NO: 481 - protein, 527 aa, unknown
  environmental sample
MNKKTLISSLLITLAFLFLNVQKVSAAIDYNLFNYNYPVSAYYPKSSDKANVMGRIIKINNVRNDYSVSIPIDVSQNSEGKLNYFGLTTSTNAYFTHDSGNSITNAGSLTGPNTLVGPGLQNPVKLPIPSSTITIDGQTYYFNYYVVQVVTEKVISPINEVQGNNYALQPLDTLPANANFAWAYYSDSPGAIIHYKTEDGTELLTSPTLISESGDTIPSEVRDFTGYTLVSVPEEDSFKKAQLTNLTYVYRKNPVAAATVTVKYIDTQGNYISDSIPLSGNVDQEYTTEQKIISGYTFKEVQGNKSGLFSTTPQTVTYIYAKNPIEIKAGSVTIKYVDTNGNSISDVITKSGNVGSSFDSEQKVILGYTFKEVQGNKSGLFSTTPQTVTYIYTKNPIEIKTGTVTIKYVDTNGNSISDEITKSGNVGSLYTSEQKKILGYNFKEIQGIAEGQFTIESQTVTYVYTKISPPTIIKTSVIPPKTLSVKTLPKESLPETGNKFFGFTLLSGSLLILVSTTLYLLKSRKYK

SEQ ID NO: 482 - protein, 514 aa, Providencia Sp.
MNIKTFKFIDKYSNGIVVNFDNRNKKTVTISLFLDNENIKTISTNNDHYLFKVDKSGNYHVTISFIDSNKNIHHLIDSPASYYFAQQKTKQNIKKESKSKTINHKIDGINKYFLEIKSEIKSSHLIMDILPNELMNSKLILIKSNIESSVKQYEYLNLYGEDNFDRLLELSQKIEQLDYVSYCCICPDTTGYLPPKLPLNSQVLEEDTSSNEITPNFTYLQKYLDAPMGMNVRNAWEKNIDGSQAVVRHLDFGVYKNHEDLKNSNLIVVNSRPETQDCNHGTASTGCIIATKNAFGVTGIAHNCQFYFYDTDDLDQLTNDAQPGDIVSLDIQFSFGEKLLPATAVRNWWERIKIMVDKGATVILAAGNGGLDLSEPGVMTDFGDNGSMLVGACNNQTGSRAYFSNYNQKSSLINSWGDWSVTTTGYGSLQKYPGNERNYTKDYSGTSSATPLCAGALALLQGYAKQHQIILSAWGMRELIKKSTYTEGVNDGIGYRPNVNDLLKEIDKLAQITE

SEQ ID NO: 483 - protein, 552 aa, unknown
  environmental sample
MKTKINLFALFAFCSSLSFGQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKI

SEQ ID NO: 484 - protein, 551 aa, Chryseobacterium Sp.
MKTKIQIFSLFMFSCSLCLAQKPSNGDSYAKANIYVCFSKGIASAKAAFAQNPELEKLARENSMSFTYDLGFTDEKLSEMARNSKLNGYSPESVEKLKRIFKADLPLQNEEYAQRLAQALERFPEVEYASVMSSTPVEPPLINAFVATPDLENLQTYLNDNPGINAKYAWSRGITGQNIRIRDVEYGFYKTHEMLANQNSIQLEPGYSPNSGLSNNNYRDHGTAVVSILGSVKDNIGLTGAVYNASEIKGYMEWTTVGYNRAAAVSRSINASQAGDIILYEMQTGGKDGQYCPAEYDKVIWDLTKAATDSGIIIIAAAGNGNQNLDDPFYASYMSRGNSGAIIVGAGSPNTTHSKLSFSTYGNRVDVQGWGSSVLAAGYGSYAKYDNDNNRTYNYFSGTSSATPTVASAAVLIQSYYRQTTGQYLSPAAMKNLLISTGIPQGGTVANQKIGPLPNVKNAILQLEGKSATAVKALPSLEVKIYPNPSQNVITLQNVENKKLDFEIINMQGRSVIRGTAMPEEKIDLSSLLPGQYIITISEGQRRVVEKLIKQ

SEQ ID NO: 485 - protein, 551 aa, custom Sp.
MKTKINLFALFAFCSSLSFGQESQPKLNQDQNSIIYVCFSKGINSEKTAFSRNADLERFSRENKISFKYDLDFTDGKLDEMARNSKAIGNSSESVEKLKRIYKADLPLQNEETTQKIIHSLERFPEIEYVSVMNATPIEPPLINAFVATPDLESIQTYLNDNPGINAKYAWSRGITGQNIRVRDVEYGFYKTHEMLTNQNSIQLEPGYSPNAGLANNNYRDHGTAVVSILGSIKDNIGLTGAAYNTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTSPLEVKIYPNPSSSSIAIQSTENKKLDFEIINLQGRTVIKSSVLSDEKIDISQLSTGQYIININEGQRRVVEKFTKL

SEQ ID NO: 486 - protein, 552 aa, custom Sp.
MKSRINLFALFAFCSTLSFGQDSQPKMANDQNSIIYVCFSKGINSEKTAFSRNADLERFSRENHISFKYDLDFTDNKLDEMARSSKAIGNSGESVEKLKRIYKADIPLQNKEASEKIIHILERFPEIEYVSVMSAEPIEPPLVNAFVVTPDLESLQTYLNDNPGINAKYAWSRGITGQNIRVRDVEYGFYKTHEMLSNQNSIQLEPGYSPNAGLANNNYRDHGTAVVSILGSIKDNTGLTGAAYSASEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTFGNRVDVQGWGSSVMAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSALEVKIYPNPSSSSIAIQSSENKKLDVEIINLQGRTVIKSSVLPNEKIDISHLPTGQYMININEGQRRVVEKLTKL

SEQ ID NO: 487 - protein, 724 aa, custom Sp.
MAPLSSKLKPTFSNRLALAATIGSIAIMPAIPSYAQILSTDNLPTLGLGSDAFQFDPLPSSDGTERFLAKYGQNAANLTSEENKTKNLSEMAQDYARQKAADVATDEISHWLSKAGNARLNINLDKQLSIKNTQLDWLIPWYDQPDLLLFSQHSIHRTDGRLQTNHGIGLRHFNQNSMMGLNTFFDHDLSYHHSRLGFGLEYAQDYAKISANSYLRLSSWRSTSELKDDYDARPANGWDIQVEGWLPTYSNLGANLKLEQYYGDDVALFGKNKRQKNPMATTVGVHWTPFPLLGINAEHKIGNGNTNETRVNLGLTWLLGKNLAQHLDVSAVDATHRISSNRHDFVNRNNNIILEYQNKNLILLSLPQVIQGVTGEEVSIIRNLISEYPLEKIIVEAPELVAAGGSITLNGLKSSVKLPSYKIEENDVKNQQLNRYRLTVTAYDIKGNMSPQAETLVEVSNTGLLAIIHKNGTKKSNVIANGRDPNVFTVVIKDALGHTVPNAKVNFTLPVGLTSFNQKNTSYYSLFNHFMWKAQVAKSASEQEFAIIANSKGEASIQFTASVSGSYALKASTQYGAEINEQFNFKPDIDQSFIGSIEIMQNNALADGNSKNKIKFHIVNNSRQSIAGAQVYFSGKNVAISPTIPTDEQGNTELEISSLTAGTTEIIATLNGDSRVIPVNFIDKNATYHSQENRIVYKGALFRQPTHKPATQTDSLWHLFGQLF

SEQ ID NO: 488 - protein, 1271 aa, unknown
  environmental sample
MSRLKLSRNQHRAVSGANADQYRTTAPVFGLMTSAHRAATILLFILCFFFASLAQAAVNTGLSGDDRYAGRFPIGFEFQYYDKTYNRFYVSTNGLIQFANPSIDYDNTCLPGELNNTLYVFWDDLRTNVDGQPTGKIEYQTLGDAPNRRLVVQWTNQYYFGTNLPMGTFQAILYEGSNQIKYQYRNLLDERSRGDSATVGLQGPEGQFAQFGCNEANLLESGQAVTFTPSEDGLSYVVDGQAEYDFIDISGFTVDYPALLSAYTNQAPGWEWNRNSDLNAYQIDIQNAAGESVLQEIVGNVGQYIYQAGDIHGATWRAKVRGSINNGATWEIWSGLSSPVTVDKVKPSAAVSEFHRLSAESARISYQTTDDLSGVKSIQLQVASDAAFENVVLETSLPVNRTQYQLTQLPQAASLYARIHAVDKAGNRSDDSAVVELLIAAPSLITPVNGTRVDEPFITVSGITYPEATVQLFLDGTALETSVQADETGYFTTVIALGEERNYRLSAQAQTPLGASSASYEVQFSYQEVGATVLFAAPNADAVLTAPTEVTVIASDRSGIDNVALYVDDALLATLTEAPYSFMWQLSESDNGARTLKAIATTGKGKTFEASTNVTAEVLPPVAPPTPYTGKVNSVSPAVSYGEPIVIEGQAVERATSELMANTPLRIVLINNGFKRTIAVSSDDNGLFRYSFVPQSTDKGTYSVAVIHPNETETVAQGKFTINRVNVHIGGYNLIAARNVPAKIDVKATADSGSLGFYWTIRAEDQPDGQLPQGIRINSTPTNIPVGSTTSTHVTFNADDSAAETGHLYLVAFANESGDIVRGKLQIKYRLTEAQPALYTTPGFIETGLAQNSNITETVTLANRGLTTAQNVNLTLQDEQGSAAPSWVFLANEADIQTVKVGDTVAVNVTAQPDDSVADGIYRFNLHVRADNQASFNVPVVISVIQNGTGGVRFDVADIYTATLDANGQPILGVAGATIKLQNEAALGSQRAATNRNAITGEYTLKTDNNGLAAVDSLPPGIYLYRASAPKHEDVTGRVRIRPGVMNNEHIFLNYEIINIEFSVTETTIKDVYDVNLDVTFNANVPAPVVILEPRTINLYGMQVGEEKTGQLTLTNYGLVRADDLTFKFPQSDERFHYEFFGDIPDQLLPKTRLIIPYKVTKLKASPFPRSLVTPLSKLARSNNENCFDYNNDAQAQYGYTCANGDTSSGSDNSRFYERTGEDCEPGAPWEEDEEKENENEPKPPSTPMTDGCSQDCEGCCSPGNGAGNSY

SEQ ID NO: 489 - protein, 416 aa, Yersinia Sp.
MNNITEYNDTANFVPYNVYATSAFEFDWDSSAILKQAVLKGISFIPYVGDYLSSIIGFFWKDQERDIWQEILGRVQQLIEENVLKAIKGILLGDIAELKGKIASVVAALQDHPGTPEAKSLFMSVSVHLDSVQRKFTTFDHKTNYHILPMYSATALMQIMYWTMGIERKDDIGLNSNEVGQLQRNINLLVTHVEDYVQGIYDTELEIQYNDSAPNTVANNVMYVHGYCRVHGLEYTEIIQSIQNNGSNTKGLYSKILSYSTFFGWPTSQARILALKDEVNMPEPFKPKLINGRINQVKSVKGYIRRIGGALRVGGLEITFENGSKYSQGTVTGEFSSIDLNGSVIETMETWGSGAIDEAKFTLSDGRTFTVGQRYSTNYRKFALEGHYISGIFIASDRSELAGQAANICVSYHQKQ

SEQ ID NO: 490 - protein, 136 aa, Yersinia Sp.
MSKVTITIDSNSNEVDVKNSTEADTESLALTAAQVRTRVPTEVAPNSSTEVLYRSTPIIPESRRNVMITNDGAANVITAQYYWSHSFTSQWFLYTSIDVNVGDSKLLVSPSNSLYYSKVVLINNTSRKAYVTAEEK

SEQ ID NO: 491 - protein, 470 aa, Comamonas Sp.
MKKAKFETSSGRRVFIQRAAAGASVLSTAGLVYANDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHASSTIDKARRDNPHSTVGLAQNMPLSAMLIEKTKYQLTVLDLRDTWANLDPIRYPGKSRIKLDREIFTPVIGWLGRKNSRPDVIPVWRRPSSPLSSLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLI

SEQ ID NO: 492 - protein, 464 aa, unknown
  environmental sample
MSNPQIDTHGPRAPNPFHGHVFQPASRSYFAYENGQLDVGALNQRESGKFFPASNAGLRDSFAPDDQANARPPADGKIASAEQLTGQFLDEPGTHWTKHKVGSKKTLDVSWYFAVAHVTRRWNYFITKPDWDPSLPLSRDQFEEKPFYVVQINLEPFWSHSSAMKPSNPTVHQVPLPERTGYHVLLAVWEVADTGNAFYQVVDLEFAATETPVVGPSTPENLAASEIKEKSVKLIWDRSEGNADVAKYCITRNGITTIDVAVPNLEWTDYSVSPDTRYTYFVHAVDVMGGVSAPSRAIIVNTLPEGGINAPPTAPGLLHSMKETKNCVSLMWSASNSAVGVAKYVVYREGSEIARISGNQTTYDDATLASDTQYRFFVAALDRNDRLSVPSNVLTVRTKPDVGDDYPAWKLSGAYKAKDIIRHNGQIWVCLQSHIAYAEAWAPGASDSMTLWQAYAGNIKQHCL

SEQ ID NO: 493 - protein, 455 aa, unknown
  environmental sample
MRPHKPVALLCASAAVAIGATVLIPSAAFAHGFVGDDSGNPTHTLTARAALKANGDMGGAQWEPQSLEAPKGFPASGPADGHLASAGHEQWSALDEQREDRWQKNVVEQGDVTVDWTFTAPHMTSQWRYFMTKEGWDPNDALDRDDLELIETVSHDGSAASNNPSHEITIPSDREGYHVIYAVWDVADTANAFYNVIDVDVQPADGETPEPGEDTEAPGLVPDAAVRAVSSTEAEITWGAGSDDRGVARYQVVQLGSTQDEFRVLEEHAATARSTRLTGLQPGALYSFGVRAVDAAGNIGVAHSILTVRMPEQAAAPAAPKHLHDMGTTESTVALMWTAGDDTAGVRYEVFRDGERVGETGATNFVDVGLRAGSRHEYTVRAVNLDGIASAASNTHVATTKGDAGSEYPSWDAHGAYTKGDRVTHQGSTYEAVQSHQGHGDPNWITALSLWRPLG

SEQ ID NO: 494 - protein, 445 aa, unknown
  environmental sample
MPGKNISPRHGRVTTPESRAVLARQRGLLPDDSVPNSLEAGKFFPLYAGGLLDPVAPADSPSGTPPADGKIASAGYAAGAILDEPRSDWQKHEVRSGDKLTVAWAYHAVHTTRRWNYFITHQDWNPAEPLKRGHFEASPFYKVEFSLDPNWEHTAALTPSDPTVHELILPRREGYQVLLAVWEVANTGAAFYQVIDLQFAGASEGQAPTAPQGLSASSVSKSTIGLSWLASAASSGSHIEKYTIYRDGLGYVVVRDLDELEYLDTLLQADTTYTYFVSATDNLGRESLPSTQVTVRTWGAGGEIPAPTAPANLHEMGRTETSITLMWTGSVSTRGLLYLVYRDAVEVARLPQRTLEFTDHGLAPGNTYKYVVKAIDTAGLYSPASNELTATTQGVPQVPQWSAGAVLYEVGDRVSHQGGVYSCIQRHVSNSGWSPTAAITLWQPA

SEQ ID NO: 495 - protein, 452 aa, custom Sp.
MAKHITNPISQNITPRHGHIFSPASRAYFAWQAGDLDEGALNQRESGKFFPAVAGGLLDVYAPEDVANSPPPPDGKIASASQATGLFLDQPGSHWQKHEVRGGEVLDISWHFTANHVTRRWNYFITKEAWDPSQVLSRDQFEAEPFYTVQINLKPYWSHGNAMKPPSPTVHQMPLPIREGYHVLLAVWEVADTAAAFYQVVDLDFVGREGGGGRPTTPTCLKASSITDKQVQLTWNASISSSTVALYRITRDGSTTVDVYVPLLSWTDNSVLPGTSYSYFVTAIDDRGNQSLPSMAIQVRTQAEGGGTAPPTAPVNLHSMNTTSNTVSLMWGASTGGYPLKHYNFYRDGKQVTTIPASQTSYTDSGLTPATMYRFFVAAEDTHGQLSVPSNVLSVTTSIGEGGETPEWKLGESYRVGDKVIYQGVKYACFQAHISNAGWTPAETVNVLWLLV

SEQ ID NO: 496 - protein, 456 aa, custom Sp.
MKNIISKPKEGLSSRHGHVFSPKSRAYFAWEKGQIDDGMLNQREAGKFFPAKLSGLADPVAPTDVYSALPPRDGEIASANQGNARFLDQPGSDWPKHDVISSQLLPVRWHYSAVHVTRRWNYFITRKDWNPDLPLSREQFDEKPFFSVELTEQPFWSHGDALTPPNPTEHMLMLPERRGYHVLLAVWEIANTGNAFYQVIDLNFTDSTISLPPPAAPEALRVKGVTGNTISLTWSAPSVAAAYYTIYRDGVFADRVKAMEFTDSGLKEDTEYTYEVTSVDMSGTESARSHALTVRTQSSAAIDHPPSAPENLHCMQVTTNSISLMWSPSQSPVAIQCYILHRDGQVIARTPASQLTYVDSNLQEGTTYHYYVVAQNENGCLSAPGNQLAMTTERTSTTTPDPAPHRKWALRSTFSAGEIVSHNGSLWQCIQTHVAYSPEWAPGASDSATLWRLIKA

SEQ ID NO: 497 - protein, 651 aa, Arsenophonus Sp.
MNIKKYADNSKIIHVNHNFMQDNQSSLIRTFVIEEVNVQFIRLVFSLANMPSGSYIEITDRKRQHTRIFPLNNGATLDVTFYNNCIDIKVILPKNYHYNKNQIAELTYYEALPQDLTQIVEDSHDGRQPYMWYKNTPFFNPVRAVHFAAFNGYGGSCSFIGSANHVLTNRHVALGANSQIDPEAIKSSEMWVNWHNITNDFSSPITDIIHFDIDKVLTYGKEIGGVEDYALFTITDFDYQNAHVKTLFGGLKLQETINNERENIYIPQHGGAKPLQISARLVSSMHPFASITPQPEYGDLFILGDMEPGSSGSPLIGRETHNILGILWGRFLFTQHGISSPYLIDKLKDFISDSNIHIKAQDNIVSHNIEATPVDNAEIKVILGDKEQLIPFDTILVENHDGYSIVEMAGLDLTTRKTMPVKYKVLAIMSNHQVSHLNDPALIGEVTLRFIPYQHLQDTVIKSWFVARIERDGEIVNNYITRILSYNYDVFEIPFDVNNADCMPLIFDAKQANTILHPFTETNPNLSFYTLRHGQGPENVGEISDGYSILKTQVINAKGEKELVTFQAYRIKSVTASEPYPLISTPSRINVKCNYDFKGPSYLRVCYYPEDNLHLIGKGTFKGIIALHGSDESGSTDRLCKNILLDITING

SEQ ID NO: 498 - protein, 1261 aa, Yersinia Sp.
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYANTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 499 - protein, 1006 aa, Paenibacillus Sp.
MKRIFSLSIIITVIVSLFSPTGKLQNYTYANSVHKSVYSNNPVEQSSIGILSTSVYPDNAVVKYGEKIYINYSFNDKAHPVLINIYKDGDLQSDYYYEQSSWGDHFSYEPKDEGSYRFVVQPTDQPYYTNECTVTVYKDRIIFLPGIMGSELFLGDEQVWEPENSKNLPRIRSQINSLQMTTLGESKNNISVHNSISDYDDILAFFKNEGFHVVDFPYDWRLGSSINAQKLKERINIERAASPYSNYYIVAHSMGGIVATEFIRQGNSNLIKKMITIGTPFLGAPQAINMLETGNLTDNLLAVLLAGDAVKNLEKNVPSIYELLPTKDYFSYQTNGYIETQTYQDPYGPRMKVRKYNTFSDTESYIKNSRDWSNNGLFDKAKDFHSALDVLNTLKKVDSYFIVGDQKTTPGKLVYHSLSINDKVLADVKSIQGDGVVPVSSATVGFKLDKARTFYITRSHLGLVKSTEVQQKILKILKDKPNEFVSDKIRNETKEIKTIKFKAECPVELHINDSSGNHTGPTGAETFESNIPDINYFTDGETKIALVNDVENYKVRIVGTGYGELTFSIVWSNEKDIEDRTMRFDNVAVTPGSIFKADVNQNGQVVLQIDQNGDGNFEGSVSPTVELDLGGTQDETIPTISSHVDGVKGINEWYGKNAFYNLTGADNASGVYKTFYDLNDSEFKEYNEPIALPNTGIYNFKSYVRDKNRNDSEVLTEIVKVDTTSPTVPVMTVDPTTWTNKFVTITLDGGTDADSGFQKYQYKINQDGEWKDYKDPFVIDTEGLYNVYARSVDNVFNLSGEVTGVTKVDKTNPQKPLMKVEPLKWTNQSVEITLSGGSDTDKGFPNSGFQKYQYKIGLDGEWKDYTVPFIIDNEGLNNVYARAVDIAANLSDEVFGDAKVDKTRPSKPTGFDIDLFNYDNVRISWSPSSDNVGVTGYDIYQDSILLDNITDTAYTFNNLESNKSYTFKVIAWDEAGNSSLEGVNVVRTPLSLVGTGRDHSLHSMGS

SEQ ID NO: 500 - protein, 354 aa, Bacillus Sp.
MPNLETGVAYNIALGTNPNLVFDILGNSTEYDALVGLYAKGNNSINQQFYFFELDGGKLAVVPRNSGRPLEPGFGDQPENRIVQGAWTGTISQQWALQDRTASSVHMFNQSDGAVASYGRNDQEQFPELNPPDPSGPNPERAWYLEPAYQALLPNMVSTTPIPSPPEYSSGIYEVLPDQSEVATVSNALIPCILVNDGSVSPDIKVQQSPYYLLIKQQYWQKAVFGTVSPNTTREFLFQSGTTSLDQQSMSDTINMTIGGDFGLQFNKVSAPAKFVISNQIQTVVSTTNEQLSGFTDTIEYRNIKKNVLVGVSIYQLVTRYVLYRTDGSLVAEPWKFIDNASAVTIITEQPIDA

SEQ ID NO: 501 - protein, 820 aa, Brevibacillus Sp.
MKLPKMYKCLLATALLGSFTSYPELSHAASSEKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELEKGKLYKIKITYQPESSSANEFGLQLNWITPQGKEEIIPEGNLLLPDIKNQPENESSRKKRSISASDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINKDQLTILEQTQQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDEPGVHEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSVENNDKIMAWNAYQNSTNVFATAFEGKPEHFWIPELLGNDLYILKNKKDPTKVLDVDGSGTSNGSNIQVSDYKGTDNQKWKLEQLEAN

SEQ ID NO: 502 - protein, 653 aa, Bacillus Sp.
MFKEKNNGRLKKIVIITAACTMMSMYGAPISSTKAAIRSHAPSVYVTPQNTAASDIISIDWSPVLTAPHTYWAVHNWNQGGEGGGYAGFQQQSGFDQTGKRTLHFALWDPIASNQAIKAEYLSPISEASRFGGEGTGLKVQTTYNWKDSEWYRMTIRSWQEDGHTKFGQWIKDNKLNQWKLVAIMDHPVANVAFNHGLSMFQEDWAGNGQDVREARLKNGYSRKVSDQQWNSWNNQCISGQHDTSYQYDGGATSEYIWVKAGGNTQSTIGTGKNFNINQPSQPEMGILDFDIQNIRFEDKKLNVSWKLKEQSTPQFKGKIEIYDNEKLMGQPLKVIDNIKSYQTEVSQTMQLPQTAFAKITLTDIFDRTVEKKVGITNGNSDILVGNQFACSLKGYSDREIAKVDYNKAAEELKIKLEAGVPHAYFNSTYASIKVQNSSGSVLYNKEIVGNRQQNTESQTVSVKVGNYIELTHIEGDAVKEKTRATLTNLENNKNETIGKTARYLVTKEGLKKVEKMPETTILDGKQFAWSLKGYSDREITKVDYNKTAEELKIKLEAGVPHAYFNSTYASIKVQSSSGSVMYNKEIMGNRQQYAETKTVPIKVGDYIEFTHIEGEAAKEKTRATLTNLENGKQEYISKKRTYQVTSTGLIRQ

SEQ ID NO: 503 - protein, 319 aa, Paenibacillus Sp.
MLMMKEKKIVTAIAIASISALLAITPAVPVVAAAGVTNTAATDAGIVDWSTPIDHAMDIYGQHAGKPGTYGGSGLLGGFTDVKYREFSVEADGSPILSNSKTVFVGSSTLVNDSDMEQTLSTDSFTQQFTNSVTSSTTTGFKFGEKISSKFEIPLVAEVGAEVSTEFDFSDTSSNTKTETHTYTAQPQNIKVPPHSSVEVIVKLDTVKASGNVKLLSKMSGQKTGSIIYYNPSVQYFYNLSFHDIVDEASKYEKLSNVYANPDETITLVGAGNYEAEYGTQFMVQVMKPKPLNENGRVKRDLHEEDYAYEVTPVVNKAE

SEQ ID NO: 504 - protein, 420 aa, custom Sp.
MKLLELKSVYSEQEQERFYTRSISLGDWDYSAIIKSSVMFGLGQIPVVGKALSTIVGLFWPKNEKDVWQKSLDELREYIDNQILATIQGILNGELREIQKKMEYVARLLEESPGSPEACSEYKNLQFYLVGKDEKFRSFDELTNYKLMPMYASMILLQASYWKMGIDKKDQIGLSSIDLNSLKNHIDDLADSSRNYINRIYETELDRTYENSRPDEVANNMFAVRGYSLLHGVEAVEVVKNIRDLDFDKRFNINVISYSTAVGTITGGMIAQALTPDSEMAQPLCPEVFGQQANRIVQIIGYSGPRIGSAFRIGGLEIIFENGDSSLLGERVGNRDVFDLNGSRIKTVEMRYQGLMDEVKFTLSDGRVMQVGQGESYSGYVKYEVEGHYISGVFLSRDRATYPGRTSTASVSFNMVPAIS

SEQ ID NO: 505 - protein, 132 aa, custom Sp.
MKDQFSNNEIEKLSRGVGLETSPADESVQLLSGGTFTVPKHGSVQAAKYSTPVIPEIHKSYWIFNTGPANKIKAVFYWSHSFTSSWFEYSSVEVGIGEEKKLQAPSNSLYYSKVVLFNGTDQNATVSVTVAK

SEQ ID NO: 506 - protein, 132 aa, custom Sp.
MKDQFSNNEIEKLSRGVGLETSLADESVQLLSGGTFTVPKHGSVQAAKYSTPVIPEIHKSYWIFNTGPANKIKAVFYWSHSFTSSWFEYSSVEVGIGEEKKLQAPSNSLYYSKVVLFNGTDQNATVSVTVAK

SEQ ID NO: 507 - protein, 121 aa, custom Sp.
MKDQFSNNEIEKLSRSVQLLSGGTFTVPKHGSVQAAKYSTPVIPEIHKSYWIFNTGAANKIKAVFYWSHSFTSSWFEYSSVEVGIGEEKKLQAPSNSLYYSKVVLFNGTDQNATVSVTVAK

SEQ ID NO: 508 - protein, 506 aa, Lactococcus Sp.
MIIKNKMVKRLISTFLMSLLLASMMLVIGAGKVYAQGSVSSTSLQVSADGSDYYIIGSDFYNHFVRPTTVDLAKNKVVYNKQILTVYNGRIDKWKMSFLNQDSSGKSWFKFLSYPEATKGDIKITYTTDGINYSDSKPSLEQLKGYMVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILNDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKE

SEQ ID NO: 509 - protein, 506 aa, Lactococcus Sp.
MIIKNKMVKRLISTFLMSLLLASMMLVIGAGKVYAQGSVSSTSLQVSADGSDYYIIGSDFYNHFVRPTTVDLAKNKVVYNKQILTVYNGRIDKWKMSFLNQDSSGKSWFKFLSYPEATKGDIKITYTTDGINYSDSKPSLEQLKGYMVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKKISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKE

SEQ ID NO: 510 - protein, 1243 aa, Advenella Sp.
MNYSFRYKALHFHTLIALLLGGSAFAPIHDAVANAQTSNPQLFTPSTGGDRASFRTPEFYANWGLNLHKFDAAYAAGATGQRVKVGQLDSPLYIAHPELAGISFSTVGSYPLATTPKFDAGTGKPAYHGMHVAGIIAARKDGKGMHGGAFGATDFVAGDFARLYEAYLKAGESLFKLGQTIVSSGADFINHSYGYNFANYAFPVALPDSKTGAHGPDIRHMRQYRNNGHIEFSSANGVVNVSSAGNDRYYAAFNAAFNKHDTRPRLFRGIGNATGINSIPYLNYLATDLTDADWSRIEKGIVSAVILNGTNDINSYSNICGISKYWCIGAAGGMLAEPNKAYATALPSLPYPVDYYYPGASGQKYIYEPLNGNISSDKYRILSLAVTSKAPPGSPEAEVMDPKNLQPIYRMAMGTSMAAPTLTAGLAVTKSRFPYLQNWQIRDIVLSTAQDIGAPGIDRVYGWGAMDLEAAMGGPRTLFALSRDYIEKLKQYEIEAADKYNPIVAKADYYATQAYELKLQMIDNAQRAAEAEKAGDHQLAAQLLAQNQQLAPQEAAFRRQAYEHELTRIQPNNAADTPENAFEYINFVVNIPGKKTEACAEDACVADVWTNDISGPGGLEKKGAGLLALAGNSHYTGGTKITEGVLQFGIGGRTGSVTGNIINNSSLVFARSDEWAYKDNITGSGDVTVLGGGTFRLHGNNTYTGSTHVYDGRLAVDGSTISQTIVYSGGMLSGTGRVGGIQVRQGGIVSPGNSIGTLTVAHSGATGAAAGNAVFEPGSRLAIEVDGQGNHDVLKVENYADIHGGVVDVGIARLSRTQLAQQVRQSTQKPYEILTAGAGVTGAFDQARLDIDLPFIAAGLRYWPQTVGLTLGRSQLGFGTAGQTYNQKQIGGGIESLTSGHPLYDALLTSASRQEAANNLQQLSNVDIHASLKQVLLNDTRYMRDAALGRTGYAAVQSNDRAGMERKPHTDTNTNVWGKVLGSWQKHKGDGNAAGLDRNIGGVIFGVDHVMNHNWRAGALVGLSNSSLKSERASAKVDGYQVGAYAATEREHFGLRVGASLAHHAITTQRSGFVDVRSGNKAKYSANTMQVYGELGYKFAAKAVVIEPFINSAYIHLKTRAFNEDGDASKVSGKSQSTNVVSNILGARISNVIESGSGTAIKLSGMIGWNYNVGDINPKASVKYPGGNSFDVRGTPLSRNAFVTELGIQANPDKRLSAGLYYDGRFGRKVSDHTLSLGIRYAF

SEQ ID NO: 511 - protein, 1240 aa, Advenella Sp.
MKCLFRYKALHVHTLVALLCGGSAFAPIHDATASERKSNTQIFTPKARGDREGFRTSEFFANWGLNLHKFDAAYASGATGQHVKVGQLDNPLYVAHPELAGINFSPVGSFPLATKPKFDAGTGKPAYHGMHVAGIIAARKDGKGMHGGAFGATDFVAGDFTQLYDAYLQAGESLSKLGQTIVDSGADFINHSYGYNFGNYAFPVTLPDGKTGAHGPDIRHMQQYRNNAHIEFSSANGVVNVSSAGNDRYYAAFTAAFNKYDARPRLFRGIGNATGINSIPYLNFRAQDLSDENWSRIEKGIVSAVILNGTNDINSYSNICGISKYWCIGTAGGMLAEPDKAYATALPSLPHSVDYYYPDASGQKYIYEQLTGNISSDKYRILSLAVTSKAPPGSPESVVMDPKNLQPVYRMAMGTSMAAPTLTAGLAVTKSRFPYLQNWQIRDIVLSTAQDLGAPGIDRVYGWGAMDLEAAMGGPRALFALRRDYLEKLEKYETEAADKYNPVVAQADYYATQAYELKLQMIENAKRADEAEKAGNKDEAARLLAVNKQLAPQEAAFRRQAYEHELTRIQPNNVADTPENAFEYINFVVDIPGKKSETCAADACVADAWTNDISGPGGLEKKGKGLLALAGNNRYTGGTKIADGVLQFGIGGTSGSVTGDIINNSSLVFARSDEWAYKDSISGSGDVSILGGGTFRLQGANTYSGLTHVYDGRFAVDGSAASRAIVYGGGIVSGNGRVGGLHVRRDGIVSPGNSIGTLTVAKSDAAGTGNAVFEPHSRLAIEIDGQGHHDVLKVENEAQIHGGLVDVGIASLSRPQLAQQLRQSTHKPYTILTAGAGVTGTFDHARLDMNLPFIAAGLRYSPQTVGLTLGRNNLAFYDVGQTHNQKQIGSGIESLTPGLPLYDALLTSASRQEAIDSLQQLSSVDIHASLKQVLISDTRFMREAVLGRVGNISVPTGGAGVDREPLAVASTNVWGKVLGSWQKHKGDGNAARLDRNTGGLIFGVDHLFNPNWRAGALVGLSNSSLKSDHASAKVDSYQLGAYAATEHDRLGLRVGATLAHHEITTRRAGYFDMISRNEADYSANSLQVYGELGYKFAANAVVIEPFVNSAYTHLRTSAFEEDGDASVASGKRQSANVVSNTLGARISNTIESGSGTEFRLSGMIGWNYNFGDIDPVASVKYQGGKTFDARGTPISRSAFVTELGVQAAFKKSLSGGLYYDGRFGKKVSDHALSLGIRYTF

SEQ ID NO: 512 - protein, 1418 aa, Enterobacter Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINGKPAALATDSTVDCSDDGSQQMAEGSMRVFINSQPASRIGDRTTCDAKVMTGSDNVIIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFVLPSRLPVRWQRYWRSGNPGDSVLGRGWSLFWESRLEPYQDGLVWRAPSGDYIAFPNVPKGMRSYCESEKNWLEHHSDDSWSVYDVSGERWHYAPLKDDAPSLLQRISEPCGNAILFEWNANNTLHALTDSAGQRVVCRYDRDRLAGAWLDDEICLVSYAYDEQRQLVCVTGRGGSVRRRFRWQGGLMSAHEDANGLLSEYRWQEIDGLPRVVGFCHSGGEQLTFEYDFDNGTRRATRDDGAQAHWLVDDDDNVARFTDYDGRQTTFVYRDGELCDVILPGGAMRRSTWDKYGRMTSETDPAGRRTEYHWYRLTDRITRTVYPDGTSSQAMYDLRGRLLSETDPAGNATAYDYPDDRENLPESITDAIGGVVRLVWNHQGLLTQRTDCSGSVTRFTYDRVGQLIASEDAEGNITRREWSRAGLLSAVIHPDGSRESLVWNERGQLTGWRDPLESEVSWAYNALGLPVSLTDRIGRVRQWRYDPRGNLLRLDNGNGAEYRFTYDAVGRPLSETRPDDTVRHMEWDARGFLCALEENGRPAADGGIARRVQQFSYDDSGLLIGRTQRHAEYRYFRDLSGQITRIRRTPTAEGVALGIESDEIVYRHDANGRVLSESGINGAVGYEWDALSNLTGLTLPGEQKLAWLHYGSGHVSAIRFGQQLVTEFTRDRLHREVRRTQGAREQLRQYDSLGRRTLQRSELSTDVTMPEKALLERLYRYTARGELSGVSDTLRGEVDYGYDAEGRLLKHYEARQGHSRAQFSYDAADNLAASDDAAPVTDNRLQHWQALFMKYDHWGNLVSRRNGLYEQHYAYDAENRLVSARGTRPEGRFEARYHYDALGRRTRKIVTTTHGTTETRFLWQGYRLLQEQQESGLCNTYIYDPNEAWSPLARVDHLRDQNSGEIYWFNTDLNGAPLEVTDERGAVRWSGQYGSFGEVRHQSEGFSRLVNRTAMAHQPLRYAGQYADGETGLHYNLFRYYDPQVGRFIVQDPIGLNGGWNLYQYAPNPLGWIDPWGLSAQGLVRYKPDPSLSAQPGARATAISRAWGEERELVAAGGGSRDWTAAEREVILSTKNNRQLSSVMSEMGYTGHHINSVKGNGVLGGKWQGDPRNIVFLQNANHPSGYDEHLHGLQGHRGSYDTPGKGRLIDRNLTRKNLKSCQ

SEQ ID NO: 513 - protein, 1412 aa, Enterobacter Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINGKPAALATDSTVDCSDDGSQQMAEGSKRVSINSQPASRIGDRTTCDAKVMTGSDNVIIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFVLPSRLPVRWQRYWRSGNPGDSVLGRGWSLFWESRLETYQDGLVWRAPSGDYVAFPKVPKGLRTYCESEKNWLEHHQDDSWSVYDVSGERWHYAPLRDDAPSLLQRISEPCGNDILFEWNADNTLHALTDSAGQRVVCRYDRDRLLGAWLDDEICLVSYAYDEQRQLVSVTGRGGSVRRRFSWQDGLMSTHEDANGLLSEYRWREIDGLPRVVGFRHSGGEQLTFEYDFDNGTRRATREDGAQAHWLVDDDDNVARFTDYDGRQTTFVYRDGELCDVILPGGAMRRSTWDKYGRMTSETDPAGRRTEYHWHRLTDRITRTVYPDGTSSQAMYDLRGRLLSETDPAGSTTAYRYPDDEENLPESITDAIGGVVRLVWNHQGLLTQRTDCSGSVTRFTYDRFGQLIASEDAEGNITRREWSRAGLLSAVIHPDGSRESLVWNERGQLTGWRDPLESEVSWAYNALGLPVSLTDRIGRVRQWRYDPRGNLLRLDNGNGAEYRFTYDAVGRPLSETRPDETVRHMEWDARGFLCALEENGRPAADGGIARRVQQFSYDDSGLLIGRTQRHAEYRYFRDLSGQITRIRRTPTAEGVALGIESDEIAYRHDAAGRVLSESGIHGAVGYEWDALSNLTGLTLPGEQKLAWLHYGSGHVSAIRFGQQLVTEFTRDRLHREVRRTQGPREQLRQYDSLGRRTLQRSELSTDVTLPEQALLERLYRYTARGELSGVSDTLRGEVDYGYDAEGRLLKHYEARQGHSRAQFSYDAADNLAANDDPVPVTDNRLQHWQALFMKYDHWGNLVSRRNGLYEQHYAYDAENRLVSARGTGPEGRFEARYHYDALGRRTHKIVTTTHGTTDTRFLWQGYRLLQEQQESGLCSTYIYDPNEAWSPLARVDHLRDQSSGEIYWFNTDLNGAPLEVTDERGAVRWSGQYGSFGEVRHQSEGFSRVVNRTAMAHQPLRYAGQYADGETGLHYNLFRYYDPQVGRFIVQDPIGLNGGWNLYQYAPNPLGWIDPLGLINEFGIAGYGSPVHAKDGLTAHELLQNAWLRNNGIIKGRMSGIATTNPAIALQENAMHKTISKLQAKYGLHNPNVLKNQSALQNINRNTAITRRGIYEDLVNNRGWERQNAKKFATETAMKLREESIGFARKNGLTKC

SEQ ID NO: 514 - protein, 1407 aa, Enterobacter Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINGKPAALATDSTVDCSDDGSQQMAEGSKRVSINSQPASRIGDRTTCDAKVMTGSDNVIIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFALPSRLPVRWQRYWRSGNPGDSVLGRGWSLFWESRLETYQDGLVWRAPSGDYVAFPKVPKGLRSYCESEKNWLEHHQDDSWSVYDVSGERWHYAPLREDAPSLLQRISEPCGNDILFEWNADNTLHALTDSAGQRVVCRYDRDRLLGAWLDDEICLVSYAYDEQRQLVSVTGRGGSVRRRFSWQDGLMSAHEDANGLLSEYRWREIDGLARVVGFRHSGGEQLTFEYDFDNGLRRATREDGAQAHWLVDDDDNVARFTDYDGRQTTFVYRDGELCDVILPGGAMRRSTWDKYGRMTSETDPAGRRTEYHWHRLTDRITRTVYPDGTSSQAMYDLRGRLLSETDPTGSTTAYRYPDDEENLPESITDAIGGVVRLVWNHQGLLTQRTDCSGSVTRFTYDRFGQLIASEDAEGNITRREWSRAGLLSVVIHPDGSRESLVWNERGQLTGWRDPLESEVSWAYNALGLPVSLTDRIGRVRQWRYDPRGNLLRLDNGNGAEYRFTYDAVGRPLSETRPDETVRHMEWDARGFLCALEENGRPAADGGIARRVQQFSYDDSGLLIGRTQRHAEYRYFRDLSGQITRIRRTPTAEGVALGIESDEIAYRHDAAGRVLSESGINGEVGYEWDTLSNLTGLTLPGEQKLAWLHYGSGHVSAIRFGQQMVTEFTRDRLHREVRRTQGARDQIRQYDSLGRRTLQRSELSTDVTLPEQALLERLYRYTARGELSGVSDTLRGEVDYGYDAEGRLLKHYEARQGYSRAQFSYDAADNLAANDDPVPVTDNRLQHWQALFMKYDHWGNLVSRRNGLYEQHYAYDAENRLVSARGTGPEGRFEARYHYDALGRRTRKIVTTTHGTTNTRFLWQGYRLLQEQQESGLCSTYIYDPNEAWSPLARVDHLRDQSSGEIYWFNTDLNGAPLEVTDERGAVRWSGQYGSFGEVRHQSEGFSRAVNRTAMAHQPLRYAGQYADGETGLHYNLFRYYDPQVGRFIVQDPIGLNGGWNLYQYAPNPLGWIDPLGLAVDPIAKLSERGYSGVVQTPTGGLDYSGSNALYNKAGINPVVSIEYTGDYLQDFHAANIEAGLNQKTTPSGYVWHHLDDYNPETNKGTMQLVKQSAHQGISHTGGVSQYKAATGNAYTHPARNRARRSVGGKC

SEQ ID NO: 515 - protein, 1404 aa, Thauera Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINSKPAAIATDSAVKCSDDGSQQMAEGSKRVSINSQPASRIGDRTTCDAKVMTGSDNVFIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFVLPSRLPVRWQRYWRSGNPGDSVLGRGWSLFWESRLEPYQDGLVWRAPSGDYVAFPNVPKGMRTYCESEKNWLEHHHDDSWSVYDVSGERWHYAALKDDTPSLLQRISEPCGNDILFEWNADNTLHALTDSAGQRVVCRYDRDRLASAWLDDEICLVSYAYDEQRQLVCVTGRGGSVRRRFRWQDGLMSAHEDANGLLSEYRWREIDGLPRVVGFRHSGGEQQTFEYDFENGIRRAIRDDGAQAHWLIDDDDNVARFTDYDGRQTTFVYRDGELSDIILPGGAMRCSTWDKYGRMTSETDPAGRRTEYYWYRLTDRITRTVYPDGTSSQAMYDLRGRLLSETDPAGNATAYHYPDEEENLPESITDALGGVVRLVWNIQGLLTQRTDCSGSVTRFSYDRFGQLIASEDAEGNITRREWNNAGLLSAVIHPDGSRESLVWNERGQLTGWRDPLESEVSWAYNALGLPVSLTDRIGRVRQWRYDPRGNLLRLDNGNGAEYRFTYDAVGRPLSETRPDETVRHMEWDARGFLCALEENGRPAADGGIARRVQQFSYDDSGLLIGRTQRHAEYRYVRDLSGQITRIRRTPTAEGVALGIESDEIAYRHDAAGRVLSESGINGAVGYEWDALSNLTGLTLPGEQKLAWLHYGSGHVSAIRFGQQLVTEFTRDRLHREVRRTQGAREQFRQYDSLGRRTLQRSELSTDVTLPEQAILERLYRYTARGELSGVSDTLRGEVDYGYDAEGRLLKHYEARQGHSRAQFSYDAADNLAANDDAVPVTDNRLQHWQALFMKYDHWGNLVSRRNGLYEQHYAYDAENRLVSARGTGPEGRFEARYHYDALGRRTRKIVTTAHGTTETRFLWQGYRLLQEQQQTGLCSTYIYDPSEAWSPLARVDHLRDQSSGEIYWFNTDLNGAPLEVTDERGAVRWSGQYGSFGEVRHQSEGFSRVVNRTAMAHQPLRYAGQYADGETGLHYNLFRYYDPQIGRFIVQDPIGLNGGFNLYSYVPNPLTWIDPLGLMPWAWNPNGMGHHLIPRNKANSIGLTDLGTMKNTPTFFPDPYSAGMHEELHRAIKNDIGKIQGPWQGSAEDLFNASSRNLDSVSHIRGDLKIPSTGEILARNVTPKEAHSKLLEWFNNKQTGKASGGRCG

SEQ ID NO: 516 - protein, 1199 aa, Thauera Sp.
MFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINSKPAAIATDSAVKCSDDGSQQMAEGSKRVSINSQPASRIGDRTTCDAKVMTGSDNVFIGGDPQQTLPIQSEVPEWLYKVSDLTLLFAGLLGGWGGAAGKVGALSKLLGKIPGINKLARIACRAGTLMTGVAAAGIIARPVDIFSGQKFLSGDDELDFVLPSRLPVRWQRYWRSGNPGDSVLGRGWSLFWESRLEFYQDGLVWRAPSGDYVAFPNVPKGMRTYCESEKNWLEHHHDDSWSVYDVSGERWHYAPLRDDAPSLLQRISEPCGNDILFEWNANNTLHALTDSAGQRVVCRYDRDRLASAWLDDEICLVSYAYDEQRQLVCVTGRGGSVRRRFRWQDGLMSAHEDANGLLSEYRWREIDGLPRVIGFRHSGGEQLTFEYDFDNGIRRANRDDGAQAHWLIDDDDNVARFTDYDGRQTTFVYRDGELSDVILPGGAMRCSTWDKYGRMTSETDPAGRRTEYYWYRLTDRITRTVHPDGTSSQAMYDLRGRLLSETDPAGNATAYHYPDEEENLPESITDALGGVVRLVWNIQGLLTQRTDCSGSVTRFSYDRFGQLIASEDAEGNITRREWNNAGLLSAVIHPDGSRESLVWNERGQLTGWRDPLESEVRWAYNALGLPVSLTDRIGRVRQWRYDPRGNLLRLDNGNGAEYRFTYDAVGRPLSETRPDETVRHMEWDARGFLCALEENGRPAADGGIARRVQQFSYDDSGLLIGRTQRHAEYRYVRDLSGQIIRIRRTPTAEGVALGIESDEIAYRHDAAGRVLSESGINGAVGYEWDALSNLTGLTLPGEQKLAWLHYGSGHVSAIRFGQQLVTEFTRDRLHREVRRTQGAREQLRQYDSLGRRTLQRSELSTDVTLPEQAILERLYRYTARGELSGVSDTLRGEVDYGYDAEGRLLKHYEARQGHSRAQFSYDAADNLAANDDAVPVTDNRLQHWQALFMKYDHWGNLVSRRNGLYEQHYAYDAENRLVSARGTGPEGRFEARYHYDALGRRTRKIVTTAHGTTETRFLWQGYRLLQEQQQTGLCRTYIYDPNEAWSPLARVDHLHDQSSGEIYWFNTDLNGAPLEVTDERGAVRWSGQYGSFGEVRHRV

SEQ ID NO: 517 - protein, 1391 aa, Klebsiella Sp.
MFEAARAGDDIGHSGALAGMIVGTLVGGAIAALGGIAAGALMVAGIGASCFGIGVLLIGASLAVGFLAGEVATGVRDGIAEGMAANMTKKGVITTGSPDVFINGKSAAIATDSMVECDDDGSQQMAEGSSRVYINGLPAARIGDRTTCDAKVMTGSGNVRIGGDPEQTLSITPEVPEALYKISDLTLLFAGLAGGWGGAASKVGAVGKLLSKLPGISKIGRIACRFGAMLTAIAAGGIIARPVDIVSGQKFLSGDDELDFVLPSRLPVRWQRYWRSGNPGDSVLGRGWSLFWETRLERYQEGLVWRAPTGDYVSFPLVAKGYRTYCEAEKRWLEHHQDDTWSVYDISGERWHYAPLQNDNPSLLQRISEPCGNDILFEWNDNLTLHALTDSAGQRVVCRYEGDRLAGAWLEDEICLVSYAYDEQRQLVSVTGRGGSVRRRFRWQDGLMRAHEDANGLVSEYRWQEIAGLPRVTAFRHSGGEQLTFEYDFDNGTRRAVRDDGAQAHWLIDEDDNVAAFTDFDGRKTAFIYRDGELCDVILPGGAMRQSRWDRYGRMVQETDPAGRRTEYYWYRLTDRLTRTVYPDGTVEQSLYDLQGRLLSETDAAGNRTTYHYPDDEEPLPDSITDATGGVVRLAWNRQGLLTSRTDCSGSVTRFSYDRFGHLISSEDAEGNVTRREWNIAGQLSAVIRPDGSRETLQWNARGQLAAWRDPLESEVRWDYNLLGLPVSITDRIGRTRRWHYDPRGNLLRLENGNGGEYRFTYDAAGRPLSETRPDDTSRQMIWDSRGFLSELHENGRPAVDGGIARRRRTFSYDESGLLTGRTTRHAEYRYDHDLNGQLTRIRRTPTAEGVALGIEADDIAFNRDAAGRLVNESGVNGELSYEWDALGNLTNMTLPGGQQLSWLHYGSGHVSAIRFGSQLVTEFTRDRLHREVTRTQGAREQSRSYDSLGRRTAQRSALITEVALPEQAILERLYRYTGRGELAGVSDTLRGEVNYGYDAEGRLLKHYESRQGNSSALFAYDAADNLAANDAPVTDNRLQHWQSLFMQYDAWGNLTRRRSGLYEQHYTYDAENRLVSARGTGPQGRFEAHYHYDALGRRIRKTVTTGHGISETRFLWQGYRLLQEQHQGGQCSTCIYDPNEAWSPLARIDHLREDRIGEIFWFSTDLNGAPLEVTDEEGSLRWSGQYGSFGEVRHQTDGLTRLAQSTALAHQPLRYAGQYADSETGLHYNLFRYYDPQTGRFTVQDPIGLSGGWNLYQYAPNPLGWIDVLGLTLTKLQEMVKEVHSLLDEYAQGRKTTAIGVDSSGNYHLASSERVVPPVQRVWAKENNVNVIRGDGHAEETIMKNVSDIEHIDASRRVCLDCEGLMHEHGVTTDTPKSGKRSRNRLKGCP

SEQ ID NO: 518 - protein, 1395 aa, Pantoea Sp.
MFEAARLGDDIGHSHALAGMIAGTIVGGLIAAAGGIAAGALMIAGIGASCLGVGVLLVGLSIGVGYLTGELATAARDGIADAGAASMTPKGKITTGSPNVFINSKPAAMATNSIVACKDDGPQQMAEGSSRVYINGLPASRIDDRTTCDAKVMTGSDNVYIGGEPEQTLPIQPEVPEWVYKASDLTLLFAGLAGGVGGAAGKVGALGKLLSKIPGINKIARVACRAGALMTGVAAAGILARPVDIVSGQKFLSGDDELDFVLPSRLPLRWQRYWRSGNPGDSVLGRGWNLFWETRLERYQDGLVWRASSGDYVSFPLVPKGQRTYCEAEKRWLEHHRDDSWSLYDISGERWHFMPLRDDAPSLPLCLTEPCGNEIQFDWNPDHTLAALTDSAGQRVTCRYANNRLAGAWLDDDICLVSYAYDDIGQLVTVTGRGGSVRRRFQWCDGLMVAHEDMNGLLSEYRWQEIDGLPRVVAFRHSGGEQLDFEYDFDNGIRRARRDDGVEAHWLIDDDDHVARFTDFDGRQTMLVYRAGELCDVIMPGGAMRCSNWDRYGRMTQEIDPVGRRTTYHWFRMTDRVIRTDYPDLSATQAAYDLNVRLLTETDALNNVTTYHYPDDTELLPDSITDATGGVVKLEWNRQGLLTQRTDCSGSVTTFSYDRFGQLVRSVDAEGHVTQREWNDKGQLCAIIHPDGSRETLHWNTQGQLSAWRDPLETEVRWTYNALGLPVSLTDRIGRTRRWHYDARGNLLRLENGNGGDYRFTCDPLGRPLSEIRPDKTSRNMEWNARGFLIGLQENGQPANDGGIARRWQRFSYDDSGLITQRTTQHAEYHYRRHRSGQLASLVRTPTSDGMALGIEDDEIAFTYDVAGQLLTEAGINGKLDYEWDALGNLTHLTLPGEQQLAWLHYGSGHVSAIRFNQQLVSEFTRDRLHREIRRSQGAREQARQYDSLGRRTMQRSELHSEVVLPEKAILERAFRYSARSELESVSDTLRGDIIYGYDDEGRLLKHYEARQGHSTSHFAYDNADNLAANDDALHALPVTDNRLHHWQNLFMKYDDWGNLVSRRSGLHEQHFTYDAENRLISAKGNGPDGGFTAHYHYDALGRRTRKVVSTQHDRKEVRFLWQGYRLLQEQHENGQCQTYVYDPNEAWSPLARIDHMAAGERGDVLWFNTDLNGAPLEVTDERGDIRWSGQYGSFGEVRRQTEGFTRLAKQSALPHQPLRYAGQYADSETGLHYNLFRYYDPQVGRFTVQDPIGLEGGWNLYQYAPNPLSWIDPLGLNKCGSFTKNPDDIHFMQSSIKNQTGEHTVLNNAAALKNGTLKPTDLPAIKIWQDSSGKLWTLDHRRLAAFKLSGLKEIPVQWATEKEIAGQMWKMTTKTDGKSIILKMGDGIKRVIGG

SEQ ID NO: 519 - protein, 1397 aa, Pantoea Sp.
MFEAARLGDDIGHSHALAGMIAGTIVGGLIAAAGGIAAGALMIAGIGASCLGVGVLLVGLSIGVGYLTGELATAARDGIADAGAASMTPKGKITTGSPNVFINSKPAAMATNSIVACKDDGPQQMAEGSSRVYINGLPASRIDDRTTCDAKVMTGSDNVYIGGEPEQTLPIQPEVPEWVYKASDLTLLFAGLAGGVGGAAGKVGALGKLLSKIPGINKIARVACRAGALMTGVAAAGILARPVDIVSGQKFLSGDDELDFVLPSRLPLRWQRYWRSGNPGDSVLGRGWNLFWETRLERYQDGLVWRAPSGDYVSFPLVPKGQRTYCEAEKHWLEHHRDDSWSLYDISGERWHFMPLRDDAPSLPLCLTEPCGNEIQFDWNSDHTLAALTDSAGQRVTCRYANNRLAGAWLDDDICLVSYAYDDIGQLVTVTGRGGSVRRRFQWCDGLMVAHEDMNGLLSEYRWQEIDGLPRVVAFRHSGGEQLDFEYDFDNGIRRARRDDGVEAHWLIDDDDHVARFTDFDGRQTMLVYCAGELCDVIMPGGAMRCSNWDRYGRMTQEIDPVGRRTTYHWFRMTDRVIRTDYPDLSATQAAYDLNVRLLTETDALNNVTTYHYPDDTELLPDSITDATGGVVKLEWNRQGLLTQRTDCSGSVTTFSYDRFGQLVRSVDAEGHVTQREWNDKGQLCAIIHPDGSRETLHWNTQGQLSAWRDPLETEVRWTYNALGLPVSLTDRIGRTRRWHYDARGNLLRLENGNGGDYRFTCDPLGRPLSEIRPDKTSRNMEWNARGFLIGLQENGQPANDGGIARRWQRFSYDDSGLITQRTTQHAEYHYRRHRSGQLASLVRTPTSDGMALGIEDDEIAFTYDVAGQLLTEAGINGKLDYEWDALGNLTHLTLPGEQQLAWLHYGSGHVSAIRFNQQLVSEFTRDRLHREIRRSQGAREQARQYDSLGRRTMQRSELHSEVVLPEKAILERAFRYSARSELESVSDTLRGDIIYGYDDEGRLLKHYEARQGHSTSHFTYDNADNLAANDDALHALPVTDNRVHHWQNLFMKYDDWGNLVSRRSGLHEQHFTYDAENRLISAKGNGPDGGFTAHYHYDALGRRTCKVVSTQHDRKEVRFLWQGYRLLQEQQDNGQCQTYVYDPNEAWSPLARIDHMAAGGRGDVLWFNTDINGAPLEVTDERGNIRWSGQYGSFGEVRRQTEGFTRLAKQSALPHQPLRYAGQYADSETGLHYNLFRYYDPQVGRFTVQDPIGLEGGWNLYQYAPNPLSWVDPLGLSNCGAPNKKTSYEGISRRDAFRQAKRDAGIPMNQHPSSITRPDLLDGSGKKILDSTGQPIKTRQYEFVDKRGQSVFLQEHSLGHTKATSGHGAEPHFNLRPLDNLNTGSVPGTHGHYNFP

SEQ ID NO: 520 - protein, 559 aa, Meta Sp.
MSSWVHPIARSLLACGAITLLTIAPTQADPASQQLRDQQQAQRQREQLQQLERLQRLQPITSHDDRSAFTDTSDNCWSITGVRLTGNQKLPTHQLQPTVQALSQPCMGIASINQLLKGLTQQYVEAGYPTSRPYLARPPKHEQPLDIVIIEGFVESIELTDGELPLSLQGAFPGLLGKPLHLPDIEQGLDQLNRLRAYDLGIELLPGELQGGTRVVLQPRQVTSPWHLDTRLDNRGSELVGRHRLNLGLGLDSPLGMNGDLRLSMASTVFNAPGQSRGLNLYYSLPYGPWTFTLNASRMSYRAPVPESHIVSNGKSRFLGLGAERLLWRNQRGILSASARVDRKQLITRSDSTVISLQSPTLATLEAGLNLLWIDRGLWNAYLGVSQGMDWFGADRPLPQAQTPRPDFLKYRVNLLHLRQGPGHWPWRWQSELTGQYSADVLPAVEQFQLSDDSAVRGFRQHTASGASAAVWRNTLSQPLDLAWTHSVQVRPTVGLDLGWTRFARASASQRLAGAAAGVELSLPQSRLRLDYQRALYASDKPAKGLERGYWVLDWTLTI

SEQ ID NO: 521 - protein, 559 aa, Pseudomonas Sp.
MSSWVHPIARSLLACGAITLLTIAPTQADPASQQLRDQQQAQRQREQLQQLERLQRLQPITSHDDRSAFTDTSDNCWSITGVRLTGNQKLPTHQLQPTVQALSQPCMGIASINQLLKGLTQQYVEAGYPTSRPYLARPPKHEQPLDIVIIEGFVESIELTDGELPLSLQGAFPGLLGKPLHLPDIEQGLDQLNRLRAYDLGIELLPGELQGGTRVVVQPRQVTSPWHLDTRLDNRGSELVGRHRLNLGLGLDSPLGMNGDLRLSMASTVFNAPGQSRGLNLYYSLPYGPWTFTLNASRMSYRAPVPESHIVSNGKSRFLGLGAERLLWRNQRGILSASARVDRKQLITRSDSTVISLQSPTLATLEAGLNLLWIDRGLWNAYLGVSQGMAWFGADRPLPQAQTPRPDFLKYRVNLLHLRQGPWHWPWRWQSELTGQYSADVLPAVEQFQLSDDSAVRGFRQHTASGASAAVWRNTLSQPLDLAWTHSVQVRPTVGLDLGWTRFARASASQRLAGAAAGVELSRPQSRLRLDYQRALYASDKPAKGLERGYWVLDWTLTI

SEQ ID NO: 522 - protein, 560 aa, Meta Sp.
MSSWVHPIARSLLACGAITLLTIAPTQADTASQHLRDQQQAQRQREQLQQLERWQRLQPITAHDDDEAASDTADNPCWAISGVRLAGNHKLATQTLQPTVQALSQPCMNIGDINQLLKGLTEHYVKAGYPTSRPYLARHPEHDAPLDIIVIEGFIESIELTDANLPLSLQGAFPDLLGQPLHLPDLEQGLDQLNRLRAYDLGIDLLPGQMQGGTRVLLQPRRVASPWHLDTRVDNRGSALTGRHRLNLGLGLDSPLGLNDDLRLSLLSTVLDAPGQSRGVNLYYSIPYGPWTFNLSASQMRYRAPIPQSHLSSNGDSRVFGLGAERVLWRNQRGILSASTRLDRKQLVNRANSTVIAVQSPTLTTFEAGLNLLWLDHGLWNAYLGISRGLDWFGADRPFPQKQAPRPDFFKYRANLLHLRQGPAHLPWRWHSELALQYSTDVLPVVEQFQLSDDSAVRGFRQHSASGASAAVWRNTLSQALPLNLAQPVQVRPTLGLDLGWSRFARSSTPQRLAGAAAGVELSLAQSRLRLDYQRALYASERPTSGLERGFWVMEWTLNI

SEQ ID NO: 523 - protein, 1042 aa, Meta Sp.
MTAPERRLLPNAADKTALKAIATTIVQNCPSLLDAARQVAIELLTDKGLSGLDPDQVYFHRFKTAQSSALTFTGWEHLLEKPYETLTLTQLVIHRFRATDQDNADLLGLYCGFYSDGPDAENFNQNNEVRLLGSDVLKAFWAVDFSTRYSDQLAKFWQTSSEDFRAMAKCSFLSQAVQALQQGDVDGNDFQRIVSSLIGPVTWPVTLQMLRSTYPVGAQVRTLDLDGHVATNVLRLVEDSGRQTLYLPGQAQAFRLMDTAADLHWWLLEQMNSEQKRPLFLKHFSLADSNHITENLTDLMNRLVSTWGHSDHRMINRSNVAISGDAFTWLSESTRAGMIAEAHLVLTSNSELRRKLWTGYLSAGLKVFGPMAAVGWPVALPLIGAGVANMGLNIDQAINGITATERRAGVIGAVLSAIETVFNVPFLIGTGAQLEVGPQVEYAEAEEMRGLVELASADTRLLPPVDPPTVTAAEEASSELANEIPSGATLVDATEPLNTPATRQGPTFPQVPASYRCNELLAQHSVEATPGKYEGIYRLDKEPGHAIEMDGAAYYVRYFADSQDSGNWAIINPERPNQFAYSLPVRLGSAGKWERMPALRLRGGGQCVGKACAPETDLSPSEATPSVDLPRVEPLPGVPCPLRLVTALKDISETEKPGMRRWAMNLPNASAESTSAGRRYLPATDRYQAHFSEQRTALLNNAGEFFRELKWTNLPGRPLIPQIDPLMQTEELIDLMFANTDGLAVGETLDRIASMRFMIENMPTFARHIRTLYVRGLLSDFAQEDLNHFYLSGDMSEDLTTYLSSLGTDPENRFNMLELITSAQANGVRVHGLDAAQTCTLKVPLTSIEEQMIKTRLATQIMERDKLLNRPGKWLALVDATNTNTFRDLPGISELRGGIGLRIEEVWPDEAADVRIDPGVEVARGPFHNGATTSNAFDPLFADLRLQVKAPVPPWNDATLEKLLHRNGMFVIRKTEPGTYTLVRRNSASNIVQTRVHCTADGRFYIWDQSMRRITGMIFRDIAAVAERLIELGMTLQSRLPT

SEQ ID NO: 524 - protein, 1042 aa, Pseudomonas Sp.
MTAPERRLLPNAADKTALKAIATTIVQNCPSLLDAARQVAIELLTDKGLSGLDPDQVYFHRFKTAQSSALTFTGWEHLLEKPYETLTLTQLVIHRFRATDQDNADLLGLYCGFYSDGPDAENFNQDNEVRLLGSDVLKAFWAVDFSTRYSDQLAKFWQTSSEDFRAMAKCSFLSQAVQALQQGDVDGNDFQRIVSSLIGPVTWPVTLQMLRSTYPVGAQVRTLDLDGHVATNVLRLVEDSGRQTLYLPGQAQAFRLMDTAADLHWWLLEQMNSEQKRPLFLKHFSLADSNHITENLTDLMNRLVSTWGHSDHRMINRSNVAISGDAFTWLSESTRAGMIAEAHLVLTSNSELRRKLWTGYLSAGLKVFGPMAAVGWPVALPLIGAGVANMGLNIDQAINGITATERRAGVIGAVLSAIETVFNVPFLIGTGAQLEVGPQVEYPEAEEMRGLVELASADTRLLPPVDPPPVTAAEEASSELANEIPSGATYVDVTEPLNTPATRQGSTFPQVPASYRCNELLAQHSVEATPGKYEGIYRLDNEPGHAIEMNGDAYYVRYFADSQDSGNWAIIDPERPNQFAYSLPVRLGSAGKWERMPALRLRGGGQCVGKACAPETDLSPSEATPSVDLPRVEPLPGVPCPLRLVTALKDISEMEKPGMRRWAMNLPNASAESTSAGRRYLLATDRYQAHFSEQRTALLNNAGEFFRELKWTNLPGRPLIPQIDPLMQTEELIELMFANTDGLAVGETLDRIASMRFMIENMPTFARHIRTLYVRGLLSDFAQEDLNHFYLSGDMSEDLTIYLSSLGTDPENRFNMLELIRSAQANGIRVHGLDAAQTCTLKVPLTSIEEQMIKTRLATQIMERDKLLNRPGKWVALVDATNTNTFRDLPGISELRGGIGLRIEEVWPDEAADVRIDPGVEVARGPFHNGATTSNAFDPLFADLRLQVKAPVPPWNDATLEKLLHRNGMFVIRKTEPGTYTLVRRNSASNIVQTRVHCTADGRFYIWDQSMRRITGMIFRDIAAVAERLIELGMTLQSRLPT

SEQ ID NO: 525 - protein, 1044 aa, Pseudomonas Sp.
MTAPERRLLPNAADKNALKTIATTIVKTCPSLLDAARQVANELLADKGLSGLDPDEIYFHRFKTAQSSTRTFTGWEHLLEKPYETLTLTQLVIHRFRATDQDNADLLGLYCGFYSDGPQAENFNQSNEVRLLGSDVLKVFWDVDFSARYAGQLTKFWQTASEDFRALAKCNFLSQAVQALQQGDLDGTDFQRIVDSVVGPVTWPVTLPMLRATYPVGAEVRALDLDGHVATNVLRLVETNGRQTLYLPGEAQAFRLMDNEADLHWWLLEQMNAEDKRPAFLKHFALADSNHLSENLTDLMNRLVHTWGHSDHHMVNRSNVAISGDAFTWLSESTRTAMVAEAHLVLTSNSDLRKKLWMGYLTAGLKVFGPMAAVGWPVALPLIGASIANMGLNIDQAINGSTATERKAGVTGAVLNAIEIVFNVPFLIGTGAQLEVGPQVEFAEAQEMLGLIEFTSADTPLLPPAELPPATTIEAATDELTNEIPRETTSVTASEHLSMAAARQGSALPGIPGRYRCNELLAQRSAEAVPGKFEGIYRLDKEPAYAIEMDGVAYYVRYFADSEGTGNWAIVNPERPNQFAYSLPVRLGSGGKWERMPALRLRGGGQCVGKACLPEDELTSTPASATPSAELPLVQPVSPVARPLRLVTPLDDIVGMDMARMRRWAMNLPETFAELSSANRGNRAPADTYAAYFSERRAALLNEAKEYYSELNWTNLPVRPVIPQVSPQMQTTQLIDRIFANSQGLVVGETFDRIASMRFMIENMPAFARHIKTLYVRGLLSDFAQADLNDFYLSGEMSEDLRVYLSSLGTDPEGRFDLLELVKTAQANGIRTHGLETVHSYKLKIPLTSIEEQMIHARLASQIMWGDEILNGPGKWAALIEATNINTFRNLPGISELRGGIGLRIEEVSPSEVAETGIDPGLKVARGPFDNGATTRNSSDVLFADLRLQIETAAPQWTEASLEKLLHRNGMFLIEQAQNNTYTLVRRNSASNIVRTVVNRRRDGQVYIWAQSLPRISGIMFRNIAALAERLIEIGLTLQSRLPT

SEQ ID NO: 526 - protein, 1044 aa, Meta Sp.
MTAPERRLLPNAADKIALKAIATLIVQNCPNLLDAARQVAKELLAGKNLSALDPDKVYFHRFKTAQSSMLTFTGWEHALEKPYETLTLTQLVIHRFRTTDQDNADLLGLYCGFYSDGPQAQNFNQSNEVRLLGSDVLKAFWEVDFSTRYIGQLTKFWQTSADDFRALAKCNFLSQAVQALQQGDLDGTDFQRVVDSVIGPITWPVTLQMLRATFPVGTEVRALDLDSHVATSVLRFVEDSGRQTLYLPGEAQVFRLMDNEADLHWWLLEQMNSADKRTEFLQHFPLADSNSITENLTDLMNRLVHTWGHSDHHMVNRSNVVISGDAFTWSSESTHRRMVAEAHLVLTSNSDLRKKLWTGYLSAGLKIFGPMAAVGWPVALPLIGAGIANMGLNIDQAINATTVAERRAGVVGAVLNAIEIVFDVPFLIGTGAQLEIGPQVEFAEAEEMLGLIEFTSADTPPQPPLDLAPVTAIAEETDELTNEIATESTFITSTELLTMPAARQGSSFPEIPAKYRCNELLAQRSMEATPGKYEGIYRLAKEPGYAIEMAGNAYYVRYFADSADGGNWAIVNPERPNQFAYSLPVRFGSSGQWERMPALRLRGGGQCVGKACMLDVELTSTPPATTPSAELPLVEPVSPVTFPLRLVTPLDDIVGMDMAQMKRWAMNLPETSVELPGANRDHRLTANVYAAYFRERRTVLLNEAKEFYSELQWTNLPARPAIPLIDQEMPTETLIDRIFANTNGLVVGETLDRIASMRFMIENMPAFARHIKTLYVRGLLSDFAQADLNEFHISGEMTEDLRTYLSSLGTDPDERFNILELIKAAQANGIRTHGLDAAHSYKLKIPLTSIEEQMIHARLTSQIMWGDDQLNRPGKWVALVDATNTNTFRNLPGISELRGGIGLRIEEVLPNEVAGVSIDPGLEVARGPFDNGASTRNSFDVLFADLRLQVEAPWPQWTGAAQERLLHRNGMFLIEKTENNAYTLVRRNSASTIVRTTVNRGRDGQFYIWAQAMPRINGIMFRNIGALAQRLIEIGLTLQSRLPT

SEQ ID NO: 527 - protein, 1045 aa, Pseudomonas Sp.
MTSPERRLLPNAADKTALKAIAATIVQTCPSLHDAARQVANEILADKGLSGLNPDRIYFHRFKAAQSSTLTFTGWEHLLEKPYETLTLTQLVIHRFRATDQDNADLLGLYCGFYSDGPEAENFNQSNEIRLLGSDVLKAFWDVDFSARYTGQLTTFWQTSSDDFRALAKCNFLSLAVQALQQGDLDGADFQRIVGSVIGPVTWPVTLPMLQALHPVGAEVRTLDLDGHVASNALRLVEDSGRQTLYLPGEARAFLLMDNQADLHWWMLEQMNSEDKRTAFLEHFPLADRNHLSENLTDLMNRLVSTWGHSDHRMINRSNAAISGDAFTWLSESTRTGMVAEAHLVLTSNSDLRKKLWIGYLSAGLKVFGPMAAVGWPLALPLIGASIANMGLNIDQAINGTTPPERKAGVTGAVLNAIDIVFNIPFLIGTGAQLEVGPQVEFAEAEEMRGLIEFTSPDAPFLPPMDQPPVTAIDPLANVEPTNEVPTETTLASTRQLATAAARQGASFPKIPAKYRCNELLANRPVEAAPGKFEGIYRLDKEPNHAIEMDGAAYYVRYFADSEDTGDWAIVNPERPNQFAYSLPVRFGSSGKWERIPALRLRGGGQCVGKACFLDTDLSSSSAPASSTPSAELPLVEPVSPVARPLRLVTPLNDIPGMDTAKMKRWAMNLPETFAELSSANRGNPSSADTYAAYFRDRRSSLLNEAKEYYSELSWTNLPARPVIPQIDAEMQTAELIDRIFANTDGLVVGETLDRIASMRFMIENMPAFARHIDTLYVRGLLGDFAQADLNDFYLSGEMSEDLRSYLSSLGTDPDGRFNMFELIKAAQANGIRPHGLEGAHSYKLKVPLTSIEEQMIHARLASQIMWGDDLLNRPGKWVALVEATNSNTFRNLPGISEIRGGIGLRIEEATSTEVPGIRIDPGLEVARGPFDNGASTRNSSDFLFADLRLQIETPVPQWTEATVNTLLNRNGMFMLEKTQNAYTLVRRNSDGNIVRTMVNRRGDGQVYIWAQSMPRISGIMFRDIGALSQRLIEIGLTLQSRLPG

SEQ ID NO: 528 - protein, 1048 aa, Pseudomonas Sp.
MTSPERRLLPNAADKTALKAIATTIVQTCPSLFDAARQVANELLADKGLSDLDPDRIYFHRFKTAQSSALTFTGWEHLLEKPYETLTLTQLVIHRFRATDQDNADLLGLYCGFYSDGPEAENFNQSNEVRLLGSDVLKAFWDVDFSARYTGQLTTFWQTSSDNFRALAKCNFLSLAAQALQQGDLDGTDFQRVVGSVIGPVTWPVTLQMLQALHPVGAEVRALDLDGHVASNALRLVEDSGRQTLYLPGEAQAFLLMDNETDLHLWMLEQMNSEDKRTAFLQHFPLADRNHMTENLTDLMNRLVSSWGHSDHRMINHSNVAITGDAFTWLSESTRTSMVAEAHLALTSNSDLRKKLWIGYLSAGLKVFGPMAAVGWPLALPLIGASIANMGLNIDQAINGNTPTERKAGVTGAVLNAIDIVFNIPFLISTGPHLEVGPQVEFAEAEEMRGLIELTSAETPFLPPLAPPTVTAVTAVEPEAAVELTNEIPIETTIASTRELATAAARQGSSFPKIPARYRCNELLAQRSVEAAPGKYEGIYRLDKEPAFAIELDGDAYYVRYFGDSEDTGNWAIVNPERPNQFVYSLPVRLGSSGKWERMPASRLRGGGQCMGKACFLDTDLASSSAPASATPSAELPVVETVPPAARPLRLVSPLTHIVGIDMAKMKRWAMNLPETVAGRSGAIRANPSATDAYEVYCRDRRTSMLNEAKEYYSELDWTNLPVRPVIPQIDPEMQTDELFDRIFANTDGLVVGETLDRIASMRFMIENMPALSRHIDTLYVRGLLGDFAQADLNDFYLSGEMSEDLRGYLSSLGTDPDGRFNMLELIKAARANGIRTHGLDAAYSYKLKIPLTSIEEQMIRARLTTQIMWGDGLLNRPGKWAALVDATNTNTFRNLPGISELRGGIGLRIEEVTSTEVAGGSIDAGLEITRGPFSNGASARDSFDILFADLRWKIATPVPQWTDATVNTLLNRNGMFMLEKTQNVYTLVRRNSSGNIVRTTVYRRRDGQVYIWTLSMPRISAIMFRDIAALSQRLIEIGFTLQSRIPA

SEQ ID NO: 529 - protein, 1039 aa, Pseudomonas Sp.
MTAPERRLLPNAADKTALKALATTIVQTCPGLFDAARQVASELLVAKGLSGLDPDRVYFHRFKTAQSSALTFTGWEHLLEKPYETLTLTQLVIHRFRATDQDNADLLGLYAGFYSEGPTAENFNQNNEVRLLGSEVLNVFWEVDFSKRYTEQLSKFWQTSSNDFRVLAKCSFLSQAVQALQQNDLGGEDFQRIIASVIGPITWPVTLQVLRATYPVGAEVRALDLDGHVATDVLRLVEDSGRQTLYLPGEAPAFRLMDTEADLHGWLLEQMNAEDKRSAFLKHFPLAESHRISENLTDLMNRLVSTWGHSDHQMINRSNVAVTGDAFTWLSESTRSAMVAEAQLVLTSNSDLRKKLWIGYLSAGLKVFGPMAAVGWPAALPLIGASIANMGLNIDQAVNGTTAAERRTGLANAVLNGIEIVLNVPFLIGTGAQLEVGPQVEFAEAEEMAGLIEFTSANTPLLPPAEPPPATVIEEASNELANDIPINTPPATPASTSTTAAAPVPGIPARYRCNEVLVPDAVQAAPGKFEGIYRLDKEPRYAIKIGDEAYYVRYFDDSEQSGHWAIVNPERPNQFAYSLPVRLGAGGKWERLPALRLKGGGQCMGKACIPDADTTSEPSSTTPTPELPLVEPVPPSARPLRLVTPLHEVMGMDMPALRRWALNLPDTSATLPGGGHDNRSVAEAFASYFSERRASLLNEAKEFYSELSWANLPPRPVIPQVTPAMPTGELIDSIFANSNGLVIGETLDRIASMRFMIENMPAFARHINMLYVRGLLSDFAQTDLNEFFLSGEMSQDLRTYLTSLGTDPNERFNVLELVKTAQTNGIRVQGLDVAQNYKPKVPLTSIEEQLMRIRLSSRIIRSDAILNRPGKWVALSEATDTNTFRNLPGISEHMGGIGLRIEEVSSAEEAGVSIDPGLDVARGPFDNGASTRASVDVLYADLRLQIESPLPQWTPAAQEKLLHRHGMFLFEKNQNAYTLIRRDSSGNIVRTAVNSRRDGQVYIWAQSMPRISGIMFRDLAALSQRLIEIGLTLQSRLPT

SEQ ID NO: 530 - protein, 1043 aa, Pseudomonas Sp.
MTAPERRLLPNAADKTALKALATTIVQTCPGLFEAARQVASELLVAKGLSGLDPDRVYFHRFKAAQSNALTFTGWEHLLEKPYETLTLTQLVIHRFRATDQDNADLLGLYCGFYSEGPNVENFNQDNEVRLLGSDVLKVFWEVDFSTRYSEQLSKFWQTSADDFRVLSKCNFLSQAVQALQQNDLEGDDFQRIVASVIGPITWPVTLQMLRATYPVGAEVRALDLDGHVATDVLRLVEDSGRQTLYLPGEAPAFRLMDSEANLHWWLLEQMNAEDKRSAFLKHFPLAESHRISENLTDLMNRLVSAWGHSNHQMINRSNVAVAGDAFTWLSESTHSAMVAEAQLALTSNSDLRKKLWIGYLSAGLKVFGPMAAVGWPAALPLIGASIANMGLNIDQAVNGTTAAERKTGLANAVLNGIEIVLDVPFLIGTGAQLEVGPQVEFAEAEEMAGLVEFTSANTPLLPPVEPPPATLVEEASTELANDIPIETPSATSVQASTTAAAQQGPSVPGIPARYRCNEVLVSDAVESAPGKFEGIYRLDKEPRYAIRIDDDAYYVHYFADSEESGHWAVVNPERPNQFAYSLPVRFGAGGKWERIPALRLRGGGQCVGKSCTLDIETTPEPSTTTPSAELHLVEPVPGSARPLRLVTPLHDVMGMDMAALKRWAMNLPETFATLPSAAHGNRPIAEVFAAYFGQRRAILLNEAKEFYSELNWTNLPARPIIPPITSAMTTDEVIDGIFANSRGLVIGETLDRITSMGFMIENMPLFARHIDTLYVRGLLSDFAQTDLNDFHMSGEMSQDLRTYLSSLGTDPDDRFNVLELVRTAQANGVRVHGLDVAQNYKPKVPLTSIEEQMMHARLTTRIMWGDEILNKPGKWVVLSEATNTNNFRNLPGISEHMGGIGLRIEEVSSAEEAGVSIDPGLEIARGPFDNGATTRASVDVLYADLRLQIESATPQWTPAAQEKLLHRNGMFLIEKSQNAYTLVRRDSSSNIVRTTVNRRRDGQVYIWAQSLPRISGIMFRDIAALSQRLIEIGLTLQSRLPT

SEQ ID NO: 531 - protein, 434 aa, Proteus Sp.
MSSTLKLNDGLSDIGSIIHYGISQIPVIGGVLSTIFGLLWPTDKEDIWSTIKQEVQSLINEDIQEDDWNRLVAAVNELQDKVSFINDQLINAQYDTAGPELMTVVVDIIGIEENFKIEGTNFKYAFAPLFVAAVNLKIALYLEGIKYSNDLGLSQDQVNQLKSLLQKDVQSSKSYLSPINSAIGNTYLNNIQTYFSVKLYYETSVSLFNELWSGDYEDYNAPAPLENYYVPVMAAGSFYKLISLDGQNFSVPMAFAEVADNSMMPSTNILGSLYQEPTSYPDGYINFIDVYTDLSVSHRTTGLMFTCSGSDEQYEMGMTPNNNYSFNVGQNTMSINVEGGEFINQVSVRADSFVSQIEFTTNLNNTMVAGQHPDDDPIQEVTLVSPFSINSMYVVSDVAGYIQSSGHQMCGIAISAIYNNELAMQYVSSLYKNS

SEQ ID NO: 532 - protein, 434 aa, Proteus Sp.
MSSTLKLNDGLSDIGAIIHYGISQIPVVGGVLSTIFGLLWPTDKEDIWSTIKQEVQSLINEDIQEDDWNRLVAAVSELQDKVSFINDQLINAQYDTAGPELMTVVVDLVGIEENFKIEGTNFKYAFAPLFVAAVNLKIALYLEGIKYSNELGLSQDQVNQLKSLLQSDIQNSKSYLSPINSAIGSTYLNNIQTYFSVKLYYETSVSLFNELWSGDYEDYNAPAPLENYYVPVMAAGSFYKLISLDGQNYSVPMAFAEVADNSMMPSTNILGSLYQEPTSYPDGYINFIDVYTDLSVSHRTTGLMFTCSGSDEQYEMGMTPNNNYSFNVGQNTMSINVDGGEFINQVSVRAESFVSQIEFTTNLNNTMVAGQHPDDDPVQEVTLVSPFSINSMYVVSDVAGYIQSSGHQMCGIAISAIYNNELAMQYVSSLYKNS

SEQ ID NO: 533 - protein, 434 aa, Klebsiella Sp.
MSSTLKLNDGLSDIGAIMHYGISQIPVVGGVLNTIFGLLWPTNKEDIWSTIKQEVQSLINEDIQEDDWNRLAAAVSELQDKVSFINDQLINAQYDTAGPELMTVVVDIVGIEENFKIEGTNFKYAFAPLFVATVNLKIALYLEGIKYSNELGLSQDQVNQLKSLLQSDVQRSKSYLSPINSAIGSTYLNNIQTYFSVKLYYETSVSLFNELWSGDYEDYNAPAPLENYYVPVMAAGSFYKLMSLDGQKFSVPMAFAEVADNSMMPSTNIQGSLYQEPTSYPDGYINFIDVYTDLSVSHRTTGLMFTCSGSDEQYEMGMTPNNNYSFNVGQNTMSINVDGGEFINQVSVRAESFVSQIEFTTNLNNTMVAGQNPDDDSMQEVTLVSPFSINSMYVVSDVAGYMQSSGHQMCGVAISAIYNNELAMQYVSSLYKNS

SEQ ID NO: 534 - protein, 100 aa, Proteus Sp.
MSTNYVIQPLETVTVWDDAEPIIPTVTKSVIVTNNGETKLEVVNYWAPPSHVFYPDTTYWVEPNDTIIVQAPERSFYYYRVNVTNSDATKVGAAIVEIVD

SEQ ID NO: 535 - protein, 100 aa, Klebsiella Sp.
MSTNYVIQPLETVTVWDDAEPIIPTVTKSVIVTNNGETKLEVVNYWAPPSHVFYPDTTYWVEPNDTIIVQAPQQSFYYYRVNVTNSDNTKVGAAIVEILD

SEQ ID NO: 536 - protein, 101 aa, Proteus Sp.
MSTTNYVIQPLETVTVWDDAEPIIPTVTKSVIVTNNGETKLEVVNYWAPPSHVFYPDTTYWVEPYDTIIVQAPQRSFYYYRVNVTNSDDTKVGAAIVEILD

SEQ ID NO: 537 - protein, 1486 aa, Serratia Sp.
MAEIWAARKDDELIHTSALADIASAVAEVAVYAVATAAVSAAAAAAAPALAGVAVLGAAATAASGCVGAGLIVGFATSLTGVGEHISNGCDAVANWLFPPSVSGVILTGSPNVFTNAKPAARAAGRLLTPAEIKALPAPQPPQSFWDYGAELLAAGGNILSQLWQPGVAGPSQPSQPLEEDKISCDKHPLPQYLAEGSRKVFINGQPAVRSNDRSTCEAKVSTDVSKNVQIGGDTAVVRDIKSGKLPGIGLALTVLPLLLGNPAKLVKNLPCMIGGGLAAAGVNALGEAIHAAFNPVHAATGAKVLNGEEDLDLLLPARFPLVWQRNYNSRNGYQGLFGHGWRTPFEIWVDLNDRDGVVECCLHDETGRELLFPLPEVNQPSFSAGEGLMFRRGEEGQLLIADTDGSVWRLFVPLPQNPSRLRLVSLSDEYDNALLLNYDERQRLSSITDSAGAMTLRLEYGDPRFDDRVTALRHNDEARVRYRYDDGGDLHQVIDAGGLVTREFHYNAQHLLTRHQQAGGPSFEYRWAMFDDWRVVEHRDSAGGGCTIDYDLATGLTTVTEYDGLRHQHRWNAQRLIVEYTDERGEVWHYQWNDEDMLIATRDPLGHGWHFRYDEAGNLVEEEDPLGHIRLTGWLPQRALPISVKEPNGATQHFYYDERHALIAEIDALGHTQRYLRDGYGQVVQAVDANGGISHFAYDEHGQLLRARDCSGKQTLYKYTAQGWLSEVTDAAGERVHYRYDAAGRLTQLQRAEGWQETLSWNAQGQLDRYQGANGRLTHYRYDAAGRLLATRNPLDGEVVRHYDARGRLTALRNENAESYLFHWTACNLLQEEIGLDGVSTRYRYDECRRVVERRFAANTSASFSHYFSHDAAGQLVSKQTPDGETRYRYSPIGQLLHAASDRGNAWHDEPTTAQSEVSFDYDLLGRVTREQGANGTLRYDYDPMGNRTQTTLPDGRALRALYYGSGHLLQLALDDITLSEFERDNLHRELSRTQGRLTSRVHYDRLGRKDRREIFNDNRQRPAPASSSRQWTYDYQNNLTREEHNANPFSYQRYQYDASGRLLNRDGTLPDTERYRYDPASNLLDEGQFRQRHNRVLHYQGVDYRYDVFGRTVEKRKGHYRWQYLYDADHRLCEVVRYSQHRSEAQQHVQFHYDPLGRRTQKRVWQQSQDLRQPAGKCQTTTFLWEGFRLLQETRDGMPLTYVYADQGSYEPLARIDGHAPAQVFYFHTAPNGEPESLTDSDGTLRWQSHSSAWGRIKYEENQQDLDYSQNLRLQGQYLDRETGLHYNLFRYYDPDIGRFTQHDPIGLAGGINLYQYAPNPLGWVDPLGLSCGNSWNNFQSKSKGVFASRSQASKAYNLWKKQDWAALEKFMGHGSWPPNRGFVQATPTTLMPGAKIDRYGGWTNNGVFNDRGTFVSPAGASFGSRALPLDTLEKPYRVYEVVKPIQADMGPAIPWFNQAGGGTQFELSKSISQLLAEGRIRPI

SEQ ID NO: 538 - protein, 1468 aa, Serratia Sp.
MSDIWAARKDDELIHTSPLADIASAVAEVAVYSLATAAVAAAAAAAAPALAGVAVLGAAATAASGCVGAGLIVGFTASLTGVGEHISNGCDTVANWLFPPVVSGVILTGSANVFTNAKPAARAAGRLLTADEIKALPGPQPPQSFWDYGSELLAAGGNIISQLWQPSVAGPSLPSQALEEDKIACDKHPSPQYLAEGSGKVFINGQPAVRSNDRSTCEAKVSTDVSKNVLIGGDAVVVRDIKSGKLPGIGLALTVLPLLLGNPSKLVKNLPCMIGGGLAAAGANALGEAIHAAFNPVHAATGAKVLNGEEDIDLLLSARFPLVWQRNYNSRNRYQGLFGHGWRTPFETWVDLADDGKGGVECCLHDETGRELRFPLPEVNKPSFNAGEGLMFRSGEEGQLVIADTDGSVWRLFVPLPQEPSRLRLMSLSDEYDNALLLSYDKQQRLSQISDSANAMTLALEYADARFADRVTALCHNQQTRVRYCYNDTGDLHQVVDAGGLITREFHYNDQSLLTRHQQVGGPYFEYRWAMFDDWRVVEHRDEAGGGCTIDYDLAAGLTTVTEYDGLQHSHRWNSQQLITEYTDERGEVWRYQWNDEDMLVASQDPLGHGWQFRYDEAGNLVEEQDPLGNIRLTQWLPQRALPVSIKAPNGGTQYFYYDQRHALVADVDALGHTQRYLRDDYGQVVQSVDANGGISHFAYDEHGQLIRARDCSGKQTTYSYLPQGWLTEVTDAAGESTRYHYDNVGRLTQLQRAEGWQEKLGWNAQGQLVHYQGADGRLTHYRYDSVGRLLATRNPLDGEVLRSYDTRGRLTALRNENGESYCFQWTAANLLQEETGLDGISTRYRYDECRRVIERIFAANTPAAFSHYFSHDAAGQLLNKQTPDGETRYRYNPVGQLLHAAFYRGDVWRDFQPEAESEASFSYDLLGRVLSEQGNQGTLNYDYDPMGNRTQIALPDGRTLRSLYYGSGHLLQVALDDVTISEFERDNLHRELSRTQGRLTSRLHYDRLGRKDRREIFHDNRQRPAPASSSRQWFYDYQNNLTREEQNANPFAYQRYHYDAAGRLLSQDGTLPDTERYRYDPASNLLDEGQFRQRHNRVMHYQGIDYRYDTFGRTVEKRKGHYRWQYHYDAEHRLCEVVRYSLHRSEPLQHMQFRYDPLGRRTQKQVWMQSQDLRQPGGKRQTTTFLWEGFRLLQETRDGMPLTYVYADQGSYEPLARIDGGPQAQVFYFHTAPNGEPESLTDSDGTLRWQGHSSAWGKTKYEENQQHLDYSQNLRLQGQYLDRETGLHYNLFRYYDPDIGRFTQHDPIGLAGGINLYQYAPNPLGWVDPLGLSRTCKDPSKDATQWQGPHNRDYPGIDTYNNRTLKKGTILYALHPNGDQLPPYTVSHPTVRQYRGDTLGYHEALQVKLNPAFPVRTQVRAYYVSEDIFVASGRATANPQWGKGGGMQFYIPEEARGKLIPGKIIDI

SEQ ID NO: 539 - protein, 157 aa, unknown
  environmental sample
MQEDAYRGDGLNLYAYCQNNPVNYYDPSGYMSICPEPKFATGNGDQETLYHYTNEKGKNAILESQELFPSLKANNPKDARYGDGQYLSDINPSTTKPASLASKFIRTPNKYKYTDYVEIDVSGLNVVKGRDGVFVIPNNSSLDISGRIVSSGKVGNQ

SEQ ID NO: 540 - protein, 721 aa, unknown
  environmental sample
MKRKLTFLVVLFLFTNASYLSAWAEETSTFDTSFTEQTSQLISSEAEEATSMSSTEQEATSSVHSPETSISEELTEASSEPEQEVQEAPEISMMAAAGDGTEANPYRITTFQELKDALATTVPAGQTQYIQLQNDIVYNANYIYIKQNTVIDGNGNALLYSGTNYDTAQLSAGASNLTITYKNLSFGNSTYPNNSWYGILYAGGYTGNKLTVENINYNIKNGSQPFWGGNNAGNTLTLKGKNNFYSAGTSNGGEFVEGYASVVFAENSDTTIYNDAPGATAVFYSSNQIVTVEKNASVSIESSKDYLFYNSATLNVQEQGSFSYKTIYGTNYHSNIANLCVGTLTANFAADSIGHFTTDVNSFTGTNPIFNLSSPDYVVFDATSSSKKVLDTMNPILKRIDSDTSTYRIDYLTAGKQNTYVPTVNTGSSYTISSGNINNGYSVAYAKLPTIDSLSATPATGPDISTIAAQIDNTSPANTLSSKVQYKLATNQLYSGDLASNTAQTSIQSAGTAEGVKESADVPLPGNSPPAGEASKYLFTNLSAGSYYLYAQANDQRIPGYTFESLWQETNAEVSPFVLIQFSSGSMSFNSPIPGPFGKQQNLDNYTIRNAGNVPTKINLTSITRNSDSSAKLSLVEQFDTRNQELLLSLIAEKAGSGTRTTFGPLLDKNPLNLDTLQLDPFWEADALADLYLAGDYSGPMIGPQNFSYRFSFAISAATTN

SEQ ID NO: 541 - protein, 723 aa, Enterococcus Sp.
MKKKVAFLIVLFLFTNASYLSAWAAETSTVASSSTEQTDQLINSETDTIPPVSSTEQETTSSVHRSETSISEEPTQSSSEISSEPEQEVQEAPKISVMAAAGDGTEANPYRVTTFQELKDALATSVTAGQTQYIQLQNDIVYNTNYTYIKQNTVIDGNGHAFLYNGTDYGTAHFSTGANNISVTYKNLTFGNSTYPNSSWYGILYTSNSNVSFTVENINYTIQRGSQPFWGNNNAGNTLTFKGKNNFYSSGNSYGGEFVEGYRSVTFAEGSDTTVYNDSTDATAVFYSTSQSVTVEKHASLAIESSKTYLFYGSATLNVQEQGNFSYKNIYGVNSTSSTATLSTGTLTANFAKDSIGHFTTDVNGFSGPNPTFNLNSPDYIVFDATSSSKKVLGSMNPIFKRLDSDNASYRIDYLTASKQNTYVPTVNTGSSYTISSGNIGDGYSVAYAKLPTIDSLSATPTTGPDISTMTAQIDSTRPADMLSSEVQYKLATKQLYSGTLTSNTAQTSIQNAGAAEGVKETAEVTLPGDSPPAGEASKYSFTNLPPSSYYLYAQANDQRIPGYTFKSLWQETNAEVPPVVLIQFSSGTMSFESPIPGQFGKQQNLDNYTIRNAGNVPTKVDLTSITRNSDSSAKLSLVEQFNTHEQELLLSLIAEKAGSGARTTFGPLVDKDPLSLDTLQLDPFWETDALANLYLAGDYSGPLIGPQHFSYRFSFAISAATN

SEQ ID NO: 542 - protein, 726 aa, unknown
  environmental sample
MNKGIKLAAVILLSLQAFALPAWAEEVSTTEESSSQLQQPSSASSELESSSSSQEDTVQTSDSSEESVATSEESGPEATEASIEPEQDIQEALTPKIGTLAAAGDGTEANPYLVTTFQELTDALAASVAAGQTQYIQLQNDIVYNSTYTYIKQNTVIDGNGYALLYNGTAYSTAHFSTNANNISITYKNLTFGNSAYPNSTYYGILYNHNSNVSFTVENVNYNIQVGSQPFWGNNNSGNTLTFKGKNNFYSSGRSYGGEFIEGYRNVTFAEGSDTSVYNDSTDATAIFYSTSQTVTVEKNASLSIETSKPYLFYNSATLNVQEQGKFSYKNIYGTNSTSSVATLCVGTLTANFADDSIGHFTTDVNSFTGSNPIFNLNSPDYVVFDATSSSRQVLGTMNPIFKRADTDSALYKIDYLTASGQNTYVPKVNTGSSYTVTSGNIGNGYSVAYAKMPSIESMSAIPATGPDISTIDAQIDSTSPANTLSSNVQYKLAIKQLYSGDLASDAAQSSIQNAGTADGVKDSADVTLPGTSPPVGTDTKHSFTKLPAGNYYLYAQANDQRIAGYTFNTLWQEAAADVAPFVLIQFSSGSMSFDSPIPGQFGKQQNLDNYTMRNAGNVPTEASLTSITRNTDSSDKISLVDQFSTNKQELILSLIAEKADSGEQTKLGPLTDANPLNLSTVQLNPFWDTDAQAALYLAGDYSGPMIGPQKFSYRFSFAISAVTTN

SEQ ID NO: 543 - protein, 405 aa, Morganella Sp.
MTQTSAFHLAAESTQPQLHMLTLQALNMIPPASFAVPATSPQGIATTILSMVLKLVYKKMTEPKEVDVIGIIQETLMKNTSEWLESEYQAVRKDAESLQDAISSWQNSPTEEARQLIVVRNEIAVADMRRLCILSINTAKSRGIVRLCGVCALSCLLYFFTLRDTLVFGKSWGYASDMLEKYSKALTEQADIMFKDVLTAEINNYTENDDFYDPESQAKRSVIYWTSGYTNIQDHLTYGAQQKSTRVCPERGDIAANPVNADNHTVYLGNLFLTAGNSSANGSYNYLSATEPRSYDRGGDPVTLPVRSAGQYNIRLYYAYMTNSLSFDYETQLRIEQAGKIITDAHLTDLTKTVLTPYKSGSNYGPVIYRETRVNLEEGDIVLTLHEDRSLSGGGLLQHIEFVKV

SEQ ID NO: 544 - protein, 405 aa, Morganella Sp.
MTQTSAFHLAAESTQPQLHMLTLQALNMIPPASFAVPAASPQGIATTILSMVLKLVYKKMTEPKEVDVIGIIQETLMKNTSEWLESEYQAVRKDAESLQDAISSWQNSPTEEARQLIVVRNKIAIASMSRLCILSINTAKRIGIVRLCGVCALSCLLYFFTLRDTLVFGKSWGYASDMLEKYSKTLTEQADIMFKDVLTAEINNYTENDDFYDPESQAKRSVIYWTSGYTNIQDHLTYGAQQKSTRVCSERSDIAANPVNAENHMVYLGNLFLTAGNSSANGSYNYLSAAKPRSYDRVGDPVTLPVRSAGQYHIRLYYAYMTNSLSFDYETQLRIEQAGKIVTDTHLTDLTKTVLTPYKSGSNYGPVIYRETRVNLEEGDIVLTLHEDRSLSGGGLLQHIEFVKV

SEQ ID NO: 545 - protein, 376 aa, Morganella Sp.
PPASFVVPATSPQGIATTILSMVLKLVYKKMTEPKEVDVIGIIQETLMKNTSEWLESEYQAVRKDAESLQDAISSWQNSPTEEARQLIVVRNEIAVADMRRLCILSINTAKSRGIVRLCGVCALSCLLYFFTLRDTLVFGKSWGYASDVLEKYSKALTEQADIMFKDVLTAEINNYTENDDFYDPESQAKRSVIYWTSGYTNIQDHLTYGAQQKSTRVCPERSDIAANPVNAENHTVYLGNLFLTTGNSSVNGSYNYLSATGPRSYDRGGEPVTLPVTSAGQYNIRLYYAYMTNSLSFDYETQLRIEQAGKIITDAHLTDLTKTVLTPYKSGSNYGPVIYRETQVNLEEGDIVLTFHEDRSLSGGGLLQHIEFVKV

SEQ ID NO: 546 - protein, 405 aa, Morganella Sp.
MTQTSALHIAAENTQPQLHMLTLQALNMIPPASYAVPVTSPQGIATTILSMVLKLVYKKTTEPKEVDIIDIIQEIMLKNTDEWRRLDYQAVRKNAENLQDAISSWQNEPTEEARQLIVVRNEIAIASMNRLCILSIDTAKRIGIVRLCGVCALSCLLYFFTLRDTLVFGRSWGYASDVLEKYSKTLTKQADTMFKDVLTAELNNYTENDDFYDAESQAKRSVIYWTSDYTNIQDHLTYGAQQKPTRVCLERGDIAANPVDAENHTVYLGNLFLTDGNSSANGSYNYLSVTEPRSYNRGCDPVTLPVRSAGQYHLRLYYAYMTNSLSFDYETRLKIEQTGKTVTDAHLTDLTKTVLTPYKSGSNYGPVIYRETQLNLEEGDIVLTFYEDRSLSGGGLLQHVELVKV

SEQ ID NO: 547 - protein, 519 aa, custom Sp.
MNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCQFYFYDTGDLDLIVNHVQPGDIVSLDIQFGVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESA

SEQ ID NO: 548 - protein, 519 aa, custom Sp.
MNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCTTVGYNRVDLDLIVNHVQPGDIVSLDIQFSVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESA

SEQ ID NO: 549 - protein, 520 aa, custom Sp.
MNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCTTVGYNRVDLDLIVNHVQPGDIVSLDIQTGGKDGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESA

SEQ ID NO: 550 - protein, 519 aa, custom Sp.
MNIKIFKFIDLYSNGIFVNFNNKENTNIEINLLLNDNIIESISTKNEHHLFNIDKSGNYHVEISLEAENTFNTSSKNIHHLISEPVRKKKIKKTVKSKTINHKIDGISNYYLDIKAKKKNYNKIKQDLTNVSQLSTLELKKSNIQSSLNQYDYFTFHGETNFEDLLELAEQIEKLDYVEYCSVTPDTTGYLPPQLPLNPQQLENIKSVDDTDITPDFTHLQTYLDAPKGMNIRNAWAKNINGSQAVVRHLDFGVYKNHEDLKDSNITVVNSRPETEDCNHGTASTGCIVATKNAFGVTGIAHDCQFYFYDTGDLDLIVNHVQPGDIVSLDIQFSVGGKLLPATAIRSWWERIKIMVDKGATVILAAGNGGLDLSEPGVMADFGDSGSMLVGACNHQTGTRAYFSNYNQKTSLVNSWGDWSVTTTGYGSLQKLPGNNRNYTNNYSGTSSATPLCSGALALIQDYAKQQGIILSAWQMRELIKKSTYTEGVGDGIGYRPNVDDLFKEIDKLAQITEANNEG

SEQ ID NO: 551 - protein, 517 aa, custom Sp.
MNIKIFKFIDFDSNGIFVEFNNKEKKNVEINLFLNNEIIESIETKEDHHLFNVDKSGDYHVEISLENENTLNLNSKEISFHIPQKQTKKKIKKAVKSKTINQKIDGINNYYLEIKVKKGSYDKLKQELTFNSKLPIDEIKRNIVRHSLNQYDYFTFHGDTNFEDLLELAEQIEKLDYVEYCSVTPDTTLPPKLPLNQETLDEVKSVDDDFITPDFTHLQTYLDAPKGMNIRNAWAKNINGSQAVVRHLDFGVYKNHEDLKDSNITVVNSRPETEDCNHGTASTGCIVATKNAFGVTGIAHDCQFYFYDTGDLDQIVNHVQPGDIVSLDIQFSVGGKLLPATAIRSWWERIKIMVDKGATVILAAGNGGLDLSEPGVMPDYGDSGSMLVGACNHQNGTRAYFSNYNQKTSLVNSWGDWSVTTTGYGSLQKLPGNNRNYTNNYSGTSSATPLCSGALALIQDYAKQHGIILSAWQMRELIKKSNYTEGVDDGIGYRPNVDDLFKEIDKLVQISEPNENA

SEQ ID NO: 552 - protein, 525 aa, custom Sp.
MNIKIFKFIDIYSNGIFVNFNNKENKTVTINLFLNNEIIESIETTDDSHLFNIDKSGDYHVEISLETLSENIANLNSKAISFNISQTKTKKNIKTSTKSKTINQKIDGINNYYLDIKAKKGNYDKIKQSKLLIDILPINIANSKLILIKSLISQSINQYDYLNFYGEANFESLLELAQQIETLDYVEYCCVTPDTTGYLPPKLPLNSENLEDVTSSNDITPDFTHLQTYLDAPKGMNIRNAWAKNINGSSAVVRHLDFGVYKNHEDLKDSNITVVNSRPETEDCNHGTASTGCIVATNNAFGVTGIAHDCQFYFYDTGDLDQIVNHVQPGDIVSLDIQFSVGGKLLPATAIRSWWERIKIMVDKGATVILAAGNGGLDLSEPGVMADFGDSGSMLVGACNHQNGTRAYFSNYNQKTSLINSWGDWSVTTTGYGSLQKLPGNNRNYSNNYSGTSSATPLCSGALALIQDYAKQHGIILSAWQMRELIKKSTYTEGVNDGIGYRPNVDDLFKEIDKLIQITEAPESA

SEQ ID NO: 553 - protein, 547 aa, custom Sp.
MNIKIFKFIDFDSNGIFVEFNNKEKKNVEINLFLNNEIIESIETKEDHHLFNVDKSGDYHVEISLENENTLNLNSKEISFHIPQKQTKKKIKKAVKSKTINQKIDGINNYYLEIKVKKGSYDKLKQELTFNSKLPIDEIKRNIVRHSLNQYRDYFTFHGGDTNFEDLLELAEQIEKLDYVEYCSVTPDTTGYLPPAEKLPLNQETLDEVKSVDDDFITPDFTHLQTYLDAPKGMNIRNAWAKNINGSQAVVRHLDFGVYKNHEDLKDSNITVVNSRRTPNPSLPETEDCNHGTASTGCIVATKNAFGVTGIAHDCQFYFVFPEWTQGGYDTGDALDQIVNHVQPGDIVSLDIQFSVLGGKLLPATAIRSWWERIKIMVDKGATVILAAGNGGLDLSEPGVMPDYRARGDSGSMLVGACNHQTNGTRAYFSNYNQKTSLNSWGDSVTTTGYGSLQKPLPGNNRNYTNYSGTSSATPLCSGALALIQDYAKQHYGIILSAWQMRELIKKSNYTEGVDDGGQGIGYRPNVDDLFKEIDKLVQISEPNENA

SEQ ID NO: 554 - protein, 522 aa, custom Sp.
MNIKIFKFIDFDSNGIVVNFNNGNKKTVTIGLFLDNENIEKIETKEEHHLFKVDKSGNYHVEISLEDLNENTLHLISKPISFYIPQQKTKKKIKKEVKSKTINQKIDGINNYYLEIKSKKGSYDKLKNELTFNSKLPIDLIKLNIAPVNSTNRSSLTQYDYFTLYGEDNFEDLLELAQKIEKLDYVEYCSVTPDTTGYLPPKLPLNSETLEEKDSEDDITPDFTELQTYLDAPKGMNVRNAWAKNINGSLAVVRHLDFGVYKNHEDLKDSNITVVNSRPETEDCNHGTASTGCIVATKNAFGVTGIAHDCQFYFYDTGDLDQITDDVQPGDIVSLDIQFRINGKLLPATAIRSWWERIKIMVDKGATVILAAGNGGLDLSEPGVMDDYGDSGSMLVGACNHQTGTRAYFSNYNQKSSLINSWGDWSVTTTGYGSLQKLPGNNRNYTKRYSGTSSATPLCSGALALIQDYAKQQGIILSAWGMRELIAKSTYTEGVNDGIGYRPNVDDLFAEIDKLAQISEAN

SEQ ID NO: 555 - protein, 722 aa, Providencia Sp.
MNPPSSKLKPKLPNSLLLSTAIWSTAILPMVPSYAQIVHLDDLPTLGGQAIQFEGTQPEDSTERFLAEYGQNAANFASEEKNTKNLADMAQDYARHKAANMATDEITHWLSKAGNARLNINLDKKLSIKTSQLDWLVPWYEQQDLLLFSQHSIHRTDGRLQTNNGIGLRHFQQNSMIGVNAFFDHDLSHYHSRLGFGVEYAQDYVRMSANSYLGLSTWRSASELADDYNARPANGWDIQLEGWLPTYANLGANLKLEQYYGDDVALFGKNERQKDPMAATVGVNWSPFPLLAINAEHKIGNSGTNETNAKVAFNWLLGRSLAQHLDTSAVAATRHISTNRYDFINRNNNIVLEYQKKSLISLSLPKVIQGMTGEELSIIRNLTTKYPLEKIVIEAPELIAAGGEIHLNGRESSVKLPSYKIANHSFKNSQLNLYRLTVTAYDINGNVSPQAETLIEVTNTGALTITHKNTAKRNNAVADGKNTNIFTVVIKDTLGHPVPNAKVNFTLPANLNSINQKNTGYYSLLNHFMWEAQAEKSVSEQSHSIIANSKGEASIQFTSLVSGSYAIKANIEHGTEINEIYNFKSDISQSFIGSVDIIQNNAVADGISKNKIKLHIVNNSRQSIAGAHVHFEAANAIISPIKLTDEYGNTELEISSLVEGSINIIATLNGDSRTIQVNFLRDGSAINIQPSIGTLFKSTVNEQNSHPRTPLSLLRELFQNMG

SEQ ID NO: 556 - protein, 722 aa, Providencia Sp.
MNAPSSKLKPKLPNRLVLSTAMCSIAIVPVAPSYAQIPHLDDLPTLGSHAIQFEESQPEDTTERFLAEYGQNAANFAATEKNSKNLAEMAQDYARHKAANIATDEITHWLSKAGNARFNLNLDKKLSIKNTQLDWLIPWYDQPDLLLFSQHSIHRTDGRLQTNTGIGLRHFQQNSMVGVNAFFDHDLSHYHSRLGFGVEYAQDYARMSVNSYLGLSTWRSASELAYDYNARPANGWDIQFEGWLPTYSNLGASLKLEQYYGDDVALFGKNERQKDPMAATVGINWSPFPLLALNAEHKMGSSGANETSAKIAFNWLLGKSLAQHLDASAIEATRHIPSNRYDFVNRNNNIVLEYQKKTLISLSLPKVIQGITGEELSIIRNLTTKYPLDKVVIEAPELVAAGGEIHLNGIESSVKLPSYKIANDTIKNQQLNLYRLTVTAYDTNGNVSPQAETLIEVTNTGTLTISHANTAKRNNAVADGKDANTFAVVIKDALGHPVPNAKVNFILPAGLKSIDQKNTGYDSLLNHFMWKAQATKSVSEQPYSIVTNSKGEASIQFTSFISGSYAIKAKTEHGTEINEMYSFKPDINQSFIGSIDIIQNNVMADGISKNKIKLHIVNNSRQSIAGALVHFEAPNGIISPAKLTDEHGNTELEVSSLVEGSIDIIATLNGDSRTIQVNFQRNGSAINIQPSTGTLFKSPVNEQNSPTRTPLSLLRQLFQKIG

SEQ ID NO: 557 - protein, 737 aa, Pseudomonas Sp.
MNSVNTLANRYQPPSFAERPSYAGAASGKPSYTTEQAAEQITRTGYRWTERNQDGTTPIGYRFFTPSQATYSTPAGANEFSPSQKEQARRAMQSWADVANITFTENAPEAKGQLLLGNDPNQTGHSGRASYPGIYSDGTQAWFASDGMNRPFTQGSFSRYLLAHEIGHTLGLMHPGKYNNGGSYAESAGYAEDNRAYSLMSYWWAGHLGHDHNKNGQTHYASAPLMDDITAIQKLYGANYKTRDTDTVYGFNSNTGRDFLSLNSADDAPVFSVWDGGGNDTLDFSRFHQDQTINLKAEHFSDVGGMKGNVSIAKGVTLENAIGGTGADRLIGNQADNRLTGGLGQDTLTGGLGKDTFVYNSASESTQQRPDLITDFTSGQDKIDVSAALHTAGIKDLQFVRRFSGRPGEALLGYDPNTRQHSLAIDLNGSGQAGLFIKSQGPIKPDDVISRASQPNPMPTPPARVTPQPPTPRPPSPADVAPYKPHPTPTAAPQQAPFSLQNHANASLKGTPMHAAARAVGNIREVTVTRDSWGYERVHTRSLGTGSLINDGNSVLTNQHVRDALAKGSKLELWLGYEQDSSGRMKVERKVPLDPNPLSGDARLDYAELRVDLPAGEKKALAEQFRPLKLASGPQASPGQKVFMPNHGQEALGISFLNAKGQPATLNGYDQDSRFQGTVYHDAFKKPGTSGSPLISVDTGEIVALHNGSIGASVNGQRDSMGTATRIDLIQQHRRQR

SEQ ID NO: 558 - protein, 737 aa, Pseudomonas Sp.
MTSVNNNLTHRYDPPSFAQRPSYAEAFSDKPSYTTEKAAEQITRTGYRWKERNQDGTTPISYRFFKPSQATYNTPAGANEFSPSQKEQARRTMQAWADVANIAFTENAPHAKGQLLLGNDPHTGLAGYASYPGIYSDGTQAWLASDGTNRPFTHGSLGRYVLAHEIGHTLGLMHPGKYNNGGSYADNASYAEDNRAYSLMSYWWAGHLGHDHNKNGQTHYASAPLMDDITAIQKLYGANFKTRDTDTVYGFNSTTGRDFLSLNSPDDAPVFSVWDGGGNDTLDFSGFYQDQTINLKAEHFSDVGGMKGNVSIAKGVTLENAIGGTGADRLIGNHADNRLTGGLGRDMLTGGLGKDTFVYNNASESTEQRPDLITDFTSGQDKIDVSAALQAASIKDLHFVRRFSGRPGEALLGYDPRTRQHSLAIDLKGSGQADLYIVSQGLIKPGDVISQASLPDSAPTPPIQLTPQPLGPQPPSLPIKALHKRHTTPVTAPQQAPFSLQNHASASLKGTPMHAAARAVGSIREVSVTRDSWGYERVHSRALGTGSLINDGNSVLTNQHVRDALARGSKLELWLGYEQDSSGRMKVGRKVPLDPKPLSGDARLDYAELRVDLPAQERKTLAEQFPPLTLAAHPQASPGQKVFMPNHGQEALGISFLNTKGQPTTLKGYDQDSPYQGTVYHDAFKKPGTSGSPLISVDTGEIVALHNGSIGTNVNGHRDSMGTATRIDLIQQHRRQR

SEQ ID NO: 559 - protein, 538 aa, Stenotrophomonas Sp.
MQGAVHGRRCTGDARGRPWLTNSGHAATIVILAGKDLVPVAKNSSGVGASTQKSKRSTPMSSEFRNSHLRNPVAPIEDPGRRRLMQSALAGSACLVAAPLLAHQGLVDSWGEPIGREAKASAGDDALTVLRESLLAGLNLVPVVGGFLSYLGALFIPAVGNSAEQLWREIVDARISEALLQLVKADLFGLTGVVQLYADAVRSGDLVAISTQSIAANTQFVGAVPRFAQVGQEVSLLPLYVIAASLHLALLRDMALKAVDLGYTPAYRSTLEAQAKDCIARYTAHVDRYVAAAIQAARVNNPYDWRKGDYYESNKPLTQMLQVKAALQIAVIDMRDTWYAFDPVRFPAPVAVRLNREVLSPIIGKWDRKNISPDALPTWQPPASRIKELGLSTFSTAGGASWLQGIHVVYQDGSELETGSRATQGKRLFLRNTSFHLSRVRARYLQGITRLEVDHNNGTFWQGGGPNSGANTASISYAGHRVSSIRSVGHGRAPALTSVGSLIVGFQLLNQEAVPISLQSYDRLAPNMAPQLLRWIAD

SEQ ID NO: 560 - protein, 871 aa, Chryseobacterium Sp.
MNCIFINKMKAKNVKILFAFFILSPYVLFSQQQQRLITNYILAKHAHDFKKSDLRDFQIDNIDPSESLKGEIVKIQQKFKGYPVYNAVGTAIIKEDKIEYFSDSFVKNYNTATSETATLNKEKALGNIAVALGKEEIKSFQILENPSLESAHKNFVKQRLMYADVNDNLRLAYEFSFQEPKSSNYWNILVDANSGEIISKDNLNLSCNFHSDAYFGESRISNNIESANFQKNSLFKLADNASYNVFALPIEAPTFGNRSIVSNPWILASSPAGWHSTGATSYTTTRGNNVYSYEDTANKDEPGFSPDGGINRNFDFPFSMNGTPSSNRSAAITNLFYINNRVHDIFYQFGFTESARNFQQNNFGKGGQGNDYVLAESQDGRALNNANFTTPSDGNRPLMQMYLWSTVNRYFFYNAPITAIPRVPQASPAQFGPLLNGTGVTGDVVLASTIDGCSALPAGSLTGKIGLMERGGASGCTFALKVKNAQNAGAIAAIIYNNSTAINFPSSMGGTDATITIPSVLITNDEGKFIKTQVNNSVTVNVTLKSDPTTAITPDGSFDNGIVTHEYGHGISNRLTGNGYTCLLKSASKEQMGEGWSDFFALMLTNKPGDNANVPRTVGTYASGQSTTGAGFRPAKYSPDFSINNYTYGKTNGMEIEEDGAIVPDVHSIGFIWASMLWDLHWQYVAKYGYSSDVLANKNSGSARVLQLVTDALKLQACNPTFIDGRNAILSAEMLTTKGEDRCMIWKTFAKRGLGLNALAGNKMNINDQKEDFSIPKDCTDGNSNIIIDKNLIAIYPNPAKDEFFIYLKDFTIGNLHLQIYDMSGKLIVSENRSSQDSRISVSTKDFENGVYVVKLQGIGVDISSRIIVKK

SEQ ID NO: 561 - protein, 871 aa, Chryseobacterium Sp.
MNCIFINKLKAGNVKILFSFFILFPYFIFSQQQKRLISNYILTKQSKDFKKADLRDFEIDNIDSSESLKGEIVKIQQKFKGHPVYNAVGTAIIKGDKIVYFSDSFVKNYIVSTSETATLNKEKALENIAVALGKAEIKNFQILENSLSESNPKNFTKQRLMFVDVNDNLRLAYEFSFQEPHSANYWNVLVDANSGEIISKDNLNLSCNFHSDAYSGESMVSNDVESANLQKNAFLKLADNASYNVFPLPVEAPTFGNRSIVSNPWILASSPEGWHSTGATSYTTTRGNNVYAYEDTADKDEPGFSPDGGVNRSFDFPFSMNGTPSFNRNAAITNLFYINNKVHDIFYQFGFTESARNFQQNNFGKGGNGNDYVLAESQDGGSLSNANFTTPSDGNRPVMQMYIWSTVNRYVFYNAPVTAIPRIPQASPAQFGPQLNGTGITGDVVLASVINGCSALPAGSLAGKIGLIERGGASGCTFASKVKNAQNAGAIAAIIYNNPTATNFPSSMGGTDATITIPSVLITNDEGEFVKTQLNNPVTVNITLKSDPATAITPDGSFDNGIITHEYGHGISNRLTGNGYTCLLKSASKEQMGEGWSDFFALMLTNKPGDNANVPRSVGTYASGQSTTGAGLRQTKYSPDFSINNYTYGKTNGMEIEEDGEIVPDVHSIGFIWASMLWDLHWQYAAKYGYSSDVLANKNSGSARVLQLVTDALKLQACNPTFIDGRNAILSAEMLTTKGEDRCMIWKTFAKRGLGLNALAGNKMNINDQKEDFSIPKDCLEGNSNITIDKSLISIYPNPAKDEFFIYLKDFTIGNLHLQIYDMSGKLIVSENKSSQDSRIPVSTKDFENGVYVVKLQGIGVDMSSRIIVKK

SEQ ID NO: 562 - protein, 868 aa, Chryseobacterium Sp.
MIRNFILHVKFKRSQILLLVFALLPLSAFSQDHKRVLQNYISTKLNQSFKKSDLRDFEIDNVDKSESLNGDIVKIQQKFKGYPVYNAVGTALIKDNKVLYYSDSFIKDYNSSASLTTAINKEKALENIALALNKNEIADFQILESSSHDSGYKNFVKQRLVFWELNSDLKLAYEFSLQEPDSPNYWNVLVDANSGKIISKENLNISCNFHSDAYSRGSGDIIKPQNIQDNFFKLADNASYNVFPLPVEAPTFGSRSVVSNPWILSSSPEGWHSTGAANYTITRGNNVYAYEDTADKNLPGFSPDGGAARNFDFPFSINGTPTFNRNAAITNLFYINNKVHDIFYKFGFTESARNFQQNNFGKGGIGNDYVLAEAQDGGGLNNANFTTPSDGNRPLMQMYLWSTVNRYFFYNAPITAIPRIPQASSAQFGPQLNGTGVTGDVVLASVIDGCSDLPSGSLAGKIGLIERGGVTNCTFASKVKNAQAAGAVAAIIYNNPTAANFPSSMGGTDTTITIPSVLITNDEGEFIKTQLNNSLTVNVTLKSDPATALTPDGSFDNGIITHEYGHGISNRLTGNGYTCLLKSASKEQMGEGWSDFFALMLTNKPGDDASVPRSIGTYASGQSVSGAGFRPTKYSPDFSINNYTYGDTNGMEIEEDGEIVPDVHRIGFIWASMLWDLHWQYAAKYGYSSDVTSSINSGSARVLQLVTDALKLQTCNPTFIDGRNAILSAEMLTTKGEDRCMIWKTFARRGLGLNALPGNKMNINDQVEDFSIPKDCTDGNSNVQPDKNLISIYPNPAKDEFFIYLKDFTIGSLHLQIYDISGKLVLSENRSSQDARIPVSTKDFENGVYIVKIQGIGIDSSTKIIVKK

SEQ ID NO: 563 - protein, 874 aa, Chryseobacterium Sp.
MNWTFINKKKGMNVKTLFLLFIFLLLPFIVFSQQQKRLIADYFQTKQSQNFKKLDLLNFDIDNVDYSKSLGGEIIKIQQKFKGYPVYNAVGTTLIKENKILYFSDSFVKNYNYSTSDIPLLSKESALRKIANTLQNKDLENYLIVESTLSEPHHNKYATQKLVFVEVNSALRLAYQFFLTEQKSSNSWNILVDANTGEIINKDNLKLSCSFHPGAFGHDHSSESLIKIQNKESKSSYLLSPDNASYNIFPLPIESPTFGSRSVVNNPWILASSPEGWHSDGSNHYTITRGNNVYAYEDSANSNMPGYSPDGGVNRNFNFPFSINGTPAFNQNAAITNLFYINNRVHDIFYQFGFTESARNFQQNNFGKGGLGNDFVIAEAQDSEDINNANFTTPADGNKPVMQMYLWSPVNRYFFYNAPLSAVSRVPQANSAQFGPQLNGIGVTGDIALASVIDGCSALPLGSLSGKIGLVERGGSSSCTFALKVKNAQNAGAVAAIIYNNPTAVNFPSSMGGTDSTITIPSVLITNSEGEYIKNQLNSGITVNVTLKSDPATAVTPDGSFDNGIITHEYGHGISNRLTGNGYTCLLKSQSKEQMGEGWSDFFALMLTNSTNDNATVPRSIGSYASGQSTAGLGFRPAKYSPDFSVNNYTYGRTNGMEFEEDSKIVPDVHRIGFVWATMLWDLHWQYAAKYGYSSDVTANMNSGSSRILQLVTNALKLQACNPTFIDGRNAILSAEMLTTGGTDRCMIWNTFAKRGLGINASAGNKIDINDQVEDFSIPKDCLEGNSNIAIDKSKIQIYPNPAREEFFIYLKDNTIGNIFVQVYDMTGKLVLSENRSSPDSRISISTKDFENGVYVIKLQALGVDLTSKIIVKK

SEQ ID NO: 564 - protein, 870 aa, Chryseobacterium Sp.
MGSNTIFLNKSKTRIFLSAFLAFFPISLFAQENERLIKEYILKNKISEFKKADLTHFKIDNTDFSQSLNGQVIKIQQTFKGIPVYNSLATAFIKDRKITYFNDSFVKSFTSSSDVVTISPKNALEKIAASFSRNEISDYIILNDSDKEPDHKNFAKQNFVYILSGSDLRLSHQFLFHDPGNSKYWNVLVDATSGEIISKENLTLECHFHKDAYSHNSTHPNIIIENSMEKLPSTFLADNANYNVFPLPTEAPTFGSRTLVSNPWILSSSPEGWHSTGTEKYTVTRGNNVYAYEDRNDKDQPGYSPDGGSSLSFNFPFSINGTPDFNQNAAITNLFYTANRVHDIFYQFGFTESSRNFQQNNFGKGGIGNDYLLAESQDGGGLNNANFTTPSDGKKPVMQMYLWSRVNRYFYYNAPISAIPRIPQASAAQFGPQLNGIGVTGDVMLANVIDGCTPLTPNSLAGKIGLIERGGGTNCTFALKVKNAQDAGAVAAIIYNNPGAVNFPASMGGTDASITIPSVLINNAEGEYIKTQLSNSITVNVTLKSDPATAVTPDGSFDNGIIIHEYGHGITNRLTGNGFSCLSKVQSKEQMGEGWSDFFALMLTNTPNADASVPRSIGSYASGQSASGLGFRPAKYSPDFSVNDYTYADTNGMEFEEDGELVPDVHRIGFVWGSMLWDLHWQYAAKYGYSSDVTANKNSGSARVLQLVTDALKLQTCNPTFIDGRNAVLNAEMLTTGGENRCMIWKTFAKRGLGLNASAGNKTNINDQVEDFSVPADCREGNANAAIDRSLIKIYPNPAKDEFFIYLKDNTIGKLFVQMYDMSGKLVLSEDRFSPDARIPVSTKDIENGVYVVSVQGIGVDFRTKIIIKK

SEQ ID NO: 565 - protein, 676 aa, Dyadobacter Sp.
MKIKLSPNKRVVRFLVFTSIILSVSSQLFAQRFNSVVFSNLPQDYQLYPRNAHSDGIIPISGIVEVTGYSYVSIQVFRNDTFFKYLKASLKYDSKGTGSFAAETSIKAELAQYSFKVFACKTTDSTLIVTRKNVVSGDVFIVDGQSNSTGFFDESSTDPYCRTFGKITDVLNTAPYNPADTLWALSNQQKYLTGVGTMGFEIQKQLSQRYGIPNCLINGGFHWSSSVNHAQRTENNPADLNTGYGRLLYRIQKAGLQNAVKSFIYRQGESEAYHEGSDWPGNFEKIRNNLKLDFPKLEQIYVFQIDIIYFPSTTGAELREYQRRLPERYPDVQSLATVGTKQFDGLHYGPEGYRQNGLEVSRLIAKDFYQLGDTLNINSPSLKKVFYTSQEKKQLILVFDEGQQLIYPEPYKVSDQVTLHMKDFIYLNGFPAAVSTARADGNRIVLDFANSQNASRLDYLPPYTLETNYFYPFNGPYLTNKLGMRAFTVNNFSIVDGLNSPSLISSVNPFANAVLSWNEINGATSYTLERKISGENDYKIIGKFSAASRSFEDKTNSFPGKISYRLKAGNNVAESSSYAYAEVEIPVVLGLQEPVNELITVYPNPAATHQRITVRPQNLVKGSILLINSLGQTLQRKEITHQTEAGFIIADLPAGTYFIQLQTENKSLTKKLSVVR

SEQ ID NO: 566 - protein, 981 aa, Pseudomonas Sp.
MTEQPFSLLRNLARTGNDTHEHGDDTLSFINAMEKLNIHSVFDIVRRSKSAFVHELSRISDADAALAYENARCYATQIVRLYRNQLLSSGRTQQLTRRTGVRSLVDIGPGFPNLFKENWDLFCKVGAIEAKDSPVAYLTSLYRFALEQLEGSVAEPSRIKLDERRPDLKDLLIDQQSTFTPVPTLHIVNQVLSKAINAYVGTVPEDKGKTIYQLVAEKQHPFQFPYNFHFQQISLGLDGKKPTLGELSYRVSLEVPTTSRYGSDYGKVQHSSAIAQVLMSGAGPEQQAIVLEPALSSQANADASADLTRQFFKTKYNVDYVDDASNPLNNLNVFLEKTGLDSDGVEALLAIGNHTAYASPNILSAGHTADEDSPREARLTAIKARFGAGYVNGPTTQPAMALNKDAYGIKRLVNTSVDRFDRLQRMIRLQRWTGIPFTALDTLVMAVVRSEGAVNPQMVLTVNTLRALGTYRYLNKRYGLAPDEFAAFVHQMPGEANDGRLPMFDRVFNNPALFDTPLVLDGSTLYLDQHSSQHVKARAQLSRALHLSSTQEGLRQLAIDVRELIGNAPTDFRLNLSMISSLYRQARIASMFGLTTAECRALIDLLGSLSFRKKVVSGQLDDTEPDVLDILMQLDWAVTWLEASDRDVTTLRRQAGWDMTETIVTQELTVQLEQLTNDARLAVLKGDQLASLDLPSKDDQNNTLNWWAILYYHLIDGFGLVTTQPLDEEPAVSIRRTLHERLSSIAIAEPLASEVEAKLETFVLNGYRNQHRLVEELLLTLTGLPPDRCEPVICWAGSDVSKFLAALLRDNGVIQTLSTLIRYSEVSQQLGLSARALRTFLINSRWLYADSEGPFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 567 - protein, 981 aa, Pseudomonas Sp.
MTEHPFSLLRNLARSGNDTHEHGDDTLSFINAMEKLNIHSVFDIVRRSKGAFVHELSRISDADAALAYENARCYATQIVRLYRNQLLSSGRTQQLTRRTGVRSLVDIGPGFPNLFKENWDLFCKVGAIEAKDSPVAYLTSLYRFALEQLEGSVAEPSRIKLDERRPDLKDLLIDQQSTFTPVPTLHIVNQVLSKAINAYVGTVPEDKGKTIYQLVAEKQHPFQFPYNFHFQQISLGLDGKKPTLGELSYRVSLEVPTTSRYGSDYGKVQHSSAIAQVLMSGAGPEQQAIVLEPALSSQANADASADLTRQFFKTKYNVDYVDDASNPLNNLNVFLEKTGLDSDGVEALLAIGNHTAYASPNILSAGHTADEDSPREARLTAIKARFGAGYVNGPTTQPAMALNKDAYGIKRLVNTSVDRFDRLQRMIRLQRWTGIPFTALDTLVMAVVRSEGAVNPQMVLTVNTLRALGTYRYLNKRYGLAPDEFAAFVHQMPGEANDGRLPMFDRVFNNPALFDTPLVLDGSTLYLDQHSSQHVKARAQLSRALHLSSTQEGLRQLAIDIRELIGNAPTDFRLNLSMISSLYRQARIASMFGLTTAECRALIDLLGSLSFRKKVVSGQLDDTEPDVLDILMQLDWAVTWLEASDRDVTTLRRQAGWDMTETIVTQELTVQLEQLTNDARLAVLKGDQLASLDLPSKDDQNNTLNWWAILYYHLIDGFGLVTTQPLDEEPAVSIRRTLHERLSSIAIAEPLASEVEAKLETFVLNGYRNQHRLVEELLLTLTGLPPDRCEPVIRWAGSDVSKFLAALLRDNGVIQTLSTLIRYSEVSQQLGLSARALRTFLINSRWLYADSEGPFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 568 - protein, 980 aa, Pseudomonas Sp.
MTEQPFSLLRNLARTGNDTHEHGDDTLPFINAMEKLNIHSVFDIVRRSKSAFVHELSRISDADAALAYENARCYATQIVRLYRNQLLSSGRTQQLTRRTGVRSLVDIGPGFPNLFKENWDLFCKVGTIEAKDSPVAYLTSLYRFALEQLEGSVAEPSRIKLDERRPDLKDLLIDQQSTFTPVPTLHIVNQVLSKAINAYVDTVPEDKGKTIYQLVAEKQHPFQFPYNFHFQQISLGLDGKKPTLGELNYRVSLEVPTTSGYGSDYGKVQHSSAIAQVLMSGAGPEQQAIVLEPALSSQANADTSADLTRQFFKTKYNVDYVDDASNPLNNLNVFLEKTGLDSDGVEALLAIGSHTAYASPNILSAGHTADEDSPREASLTAIKARFGAGYVNGPTTQPAMALNKDEYGIERLVNTSVDRFDRLQRMIRLQRWTGIPFTALDTLVMAVIRSGGAVNLQMVLTENTLRALGTYRYLNKRYGLAPEEFAVFVHQMPGEANDGRLPMFDRVFNNPALFDTPLVLDGSILDLDQDSSEHVKARAQLSRALHLSSTHEGLRQLAIDVRELIGNAPTDFRLNLSMISSLYRQARIASMFGLTTAQCRALIDLLGSLSFRKKVVSGQLDDTEPDVLDILMHLDWAVTWLEASDRDVTTLRRQAGWDMTETTVTQELTVQLEQLTNDARLAVVNSDQLASLDLPSKDDQNNTINWWLILSYLIDESGLVRTLPLHEEPAVSIRRTLHERLSSIDIAEPLASEVEARLATFVLNGYRNQHRLVEELLLTLTGLPPDRCEPVIRWAGSDVSKFLAALLWDNGVIETLSTLIRYSEVSQQLGLSARALRTFLINPSWLYAGSEGQFYLSPNSLYLLDRYSNWRDHCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 569 - protein, 987 aa, Pseudomonas Sp.
MTTGAPDMTEQPFSLLRNLARTGNDTHEHDDDKLSFINAMEKLNIHSVFDIVRRSKSAFVHELSRISDADAALAYENARCYATQIVRLYRNQLLSSGRTQQLTRRTGVRSLVDIGPGFPNLFKENWDLFCKVGAIEAKDSPVAYLTSLYRFALEQLEGSVAEPSRIKLDERRPDLKDLLIDQQSTFTPVPTLHIVNQVLSKAINAYVDTVPEDKGKTIYQLVAEKQHPFQFPYNFHFQQISLGLDGKKPTLGELSYRVSLEVPATSRLTSDYGKVQHSSAIAQVLMSGAGPEQQAIVLETALSSQANADTSADLTRQFFKTKYNVDYVDDASNPLNNLNVFLEKTGLDSDGVEALLAIGSHTAYASPNILSAGHTADEDSPREASLTAIKARFGAGYVNGPTTQPAMAVNKDEYGIERLVNTSVDRFDRLQRMIRLQRWTGIPFTALDTLVMAVIRSEGAVNPQMMLTVNTLRALGTYRYLNKRYGLAPDEFAAFVHQMPGEANDGRLPMFDRVFNNPALFDTPLVLDGSILDLDQDSSQHVKTRAQLSRALHLSSTHEGLRQLAIDVRELIGNAPTDFRLNVSMISSLYRQARIASMFGLTTAECRALIDLLGSLSFRKKVVSGQLDDSEPDVLDILMQLDWAVKWLEASYRDVATLRRQAGWDMTGTIVTQELTVQLEQLTNDARLAVLNSDQLASLDLPSKDDQNNTINWWLILSYLIDESGLVTTQPLHEEPAVSIRRTLHERLSAIAIAEPLASEVEARLATFVLNGYRNQHRLVEELLLTLTGLPPDRCEPVIRWAGSDVSKFLAALLWDNGVIQTLSTLIRYSEVSQQLGLSARALRTFLINPSWLYAGSEGQFYLSPNSLYLLDRYSNWRDHCGYPEEALLEYFKQANDPQRDATQCAARLASLTGWTSSEVLAANALLTGSDRIAFNMHEVDWLSRMHSASDVTGLSARQLLSATDLTATSTASHWKSVGEAVIAANR

SEQ ID NO: 570 - protein, 1004 aa, Pseudomonas Sp.
MTLLSARRERHGKQGCVMTTGAPDMTEQPFSLLRNLARTGNDTHEHGDDTLPFINAMEKLNIHSVFDIVRRSKSAFVHELSRISDADAALAYENARCYATQIVRLYRNQLLSSGRTQQLTRRTGVRSLVDIGPGFPNLFKENWDLFCKVGTIEAKDSPVAYLTSLYRFALEQLEGSVAEPSRIKLDERRPDLKDLLIDQQSTFTPVPTLHIVNQVLSKAINAYVDTVPEDKGKTIYQLVAEKQHPFQFPYNFHFQQISLGLDGKKPTLGELNYRVSLEVPTTSGYGSDYGKVQHSSAIAQVLMSGAGPEQQAIVLEPALSSQANADTSADLTRQFFKTKYNVDYVDDASNPLNNLNVFLEKTGLDSDGVEALLAIGSHTAYASPNILSAGHTADEDSPREASLTAIKARFGAGYVNGPTTQPAMALNKDEYGIERLVNTSVDRFDRLQRMIRLQRWTGIPFTALDTLVMAVIRSGGAVNLQMVLTENTLRALGTYRYLNKRYGLAPEEFAVFVHQMPGEANDGRLPMFDRVFNNPALFDTPLVLDGSILDLDQDSSEHVKARAQLSRALHLSSTHEGLRQLAIDVRELIGNAPTDFRLNLSMISSLYRQARIASMFGLTTAQCRALIDLLGSLSFRKKVVSGQLDDTEPDVLDILMHLDWAVTWLEASDRDVTTLRRQAGWDMTETTVTQELTVQLEQLTNDARLAVVNSDQLASLDLPSKDDQNNTINWWLILSYLIDESGLVRTLPLHEEPAVSIRRTLHERLSSIDIAEPLASEVEARLATFVLNGYRNQHRLVEELLLTLTGLPPDRCEPVIRWAGSDVSKFLAALLWDNGVIETLSTLIRYSEVSQQLGLSARALRTFLINPSWLYAGSEGQFYLSPNSLYLLDRYSNWRDHCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 571 - protein, 981 aa, Pseudomonas Sp.
MTEQPFSLLRNLARTGNDTHEHGDDTLSFINAMEKLNIHSVFDIVRRSKSAFVHELSRISDADAALAYENARCYATQIVRLYRNQLLSSGRTQQLTRRTGVRSLVDIGPSFPNLFKENWDLFCKVGAIEAKDSPVAYLTSLYRFALEQLEGSVAEDSRIKLHDRRPDLKGLLIDQQSTFTPIPTLHIVNQVLSKAINAYVDTVPGDKGKSIYQLVAEKQHPFQFPYNFHFQQISLGLAGKKPMLGELNYCVSLELPTTSRYGSDYGKVQHSSAIAQVLMSGAGPEQQAIVIEPALSSLANADTSADLTRQFFKTKYNVDYVDDASNPLNNLNVFLEKTGLDSDGVEALLAIGNHTAYASPNIRSAGNTADEDSPLDASLTAIKARFGAGYVNGPTTQPAMALNKDAYGIERLVNTSVDRFDRLQRMIRLQRWTGIPFTALDTLVMAVIRSEGAVNLQMVLTVNTLRALGTYRYLNKRYGLAPDEFAAFVHLMPGEANDGRLPMFDRVFNNPALFDTPLVLDGSILDLDQDSSQHVKTRAQLSRALQLSSTHEGLRQLAVDVRQLIGNAPTDFRLNLSMISSLYRQARIASMFGLTAAECRALIDLLGTLSFRKKVVSGQLDDTEPDVLDILMQLDWAVTWLKASDRDIAALRRQLGWDITETIVTQELTVQLEQLTNDARQAVLKRDQLASLDLPSKDDQNNTINWWTILDYDLIDGLGLVTTQPLHEEPAVSIRRTLHERLSSIAIAEPLASEVEARLETFVLNGYRNQHRLVEGLLLTLTGLPPDRCEPVIRWAGSDAGKFLGALLWHGGAIQTLSTLIRYSEVSQQLGLSARALRTFLISPRWLHADFGFLLPLSMNNLYLLDRYRNWRDNCGYPEETLLDYFKQANDTHRDNTQCAARLASLTGWTSSEVLAANALLTGSDRIASSMHEVDWLSRMHSASDVTGLSARQLLSATDLTATSTASHWKSVGEAVIAANR

SEQ ID NO: 572 - protein, 981 aa, Pseudomonas Sp.
MTEQPFSLLRNLAQTGNDTHEHGDDSLSFINAMEKLNIHSVFDIVRRSKSAFVHELSRISDADAALAYENARCYATQIVRLYRNQLLSSGRPQSVTRRTGVRSLVDIGPSFPNLFKENWDLFCKVGAIEAKDSPVAYLTSLYRFALEQLEGSVAEDSRIKLHDRRPDLKGLLIDQQSTFTPVPTLHIVNQVLSKAINAYVDTVPEDKGKSIYQLVAEKQHPFQFPYNFHFQQISLGLAGKKPMLGELNYCVSLELPTTSRYGSDYGKVQHSSAIAQVLMSGAGPEQQAIVIEPALSSLANADTSADLTRQFFKTKYNVDYVDDASNPLNNLNVFLEKTGLDSDGVEALLAIGNHTAYASPNIRSAGNTADEDSPLDASLTAIKARFGAGYVNGPTNQPAMALNKDAYGTERLVNTSVDRFDRLQRMIRLQRWTGIPFTALDTLVMAVIRSEGAVNLQMVLTVNTLRALGTYRYLNKRYGLAPDEFAAFVHLMPGEANDGRLPMFDRVFNNPALFDTPLVLDGSILDLDQDSSQHVKTRAQLSRALQLSSTHEGLRQLAVDVRELIGNAPTDFRLNLSMISSLYRQARIASMFGLTAAECRALIDLLGTLSFRKKVVSGQLDDTEPDVLDILMQLDWAVTWLKASDRDIAALRRQLGWDITETIVTQELTVQLEQLTNDARQAVLKRDQLASLDLPSKDDQNNTIDWWTILHYYLIDGLGLVTTQPLHEEPAVSIRRTLHERLSSIAIAEPLASEVEARLETFVLNGYRSQHRLVEGLLLTLTGLPPDRCEPVIRWAGSDAGKFLGALLWDDGAIQKVSTLIRYSEVSQQLGLSARALRTFLISPRWLHADFGFLLPLSMNSLYLLDRYRNWRDNCGYPEETLLDYFKQANDTHRDNTQCAARLASLTGWTSSEVLAANALLTGSDRIASSMHEVDWLSRMHSASDVTGLSARQLLSATDLTATSTASHWKSAGEAVIAANR

SEQ ID NO: 573 - protein, 974 aa, Pseudomonas Sp.
MTQHPFSLLRNLARSGNETHEHDDDTLSFINAMEKLNIHSVFDIVRRSKSAFVHELSRISDADAALAYENARCYATQIVRLYRNQLLSSGRTQQLTRRTGVRSLVDIGPGFPNLFKENWDLFCKVGAIEAKDSPVAYLTSLYRFAMEQLEGSVAEPSRIKLDERRPDLKDLLIDQQSTFTPVPTLHIVNQVLSKAINAYVDTVPEDKGKTIYQLVAEKQHPFQFPYNFHFQQITLGLAGKKPMLGELSYHVSLEVPATSTPTDEFGKVQQSSAIAQALMSGLSPEQQAIVLEPALTTQPEVIIPFFKTKYNIAYSDDASNPLNSLDTFMAKTELDSDAVEALLAMGGHTPYPSPNIQSAGQIAGGKPSHDEGAAAIVSRFGAGYVNGTAADPAMGLRKDIDGVVYLTNTSVDRFDRLQRMIRLQRWTGISFTALDTLVMAVIRSEGAVNPQMVLTVNTLRALGTYRYLNKRYGLAPGEFAAFVHQMPGEANDGRLPMFDRVFNNPALFDTPLVLDGSILDLDQDSSEHVKARAQLSRALHLSSTHEGLRQLAIDVRELIGNAPTDFRLNVSMISSLYRQARIASMFGLTTAQCRALIDLLGSLSFRKKVVSGQLDDTEPDVLDILMQLDWAVTWLEASDRDVTTLRRQAGWDMTETIVTQELTVQLEQLTNDARLAVVNSDQLASLDLPSKDDQNNTINWWLILSYLIDESGLVRTQPLHEEPAVSIRRTLHERLSAIAIAEPLASEVEARLATFVLNGYRNQHRLVEELLLTLTGLPPDRCEPVIRWAGSDVSKFLAALLWDNGVIQTLSTLIRYSEVSQQLGLSARALRTFLINPRWLYAGSEGQFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANR

SEQ ID NO: 574 - protein, 974 aa, Pseudomonas Sp.
MTQHPFSLLRNLARSGNDTHEHDDDTLSFINAMEKLNIHSVFDIVRRSKSAFVNELSRISDADAALAYENARCYATQIVRLYRNQLLSSGRTQQLTRRTGVRSLVDIGPGFPNLFKENWDLFCKVGAIEAKDSPVAYLTSLYRFAMEQLEGSVAEPSRIKLDERRPDLKDLLIDQQSTFTPVPTLHIVNQVLSKAINAYVDTVPEDKGKTIYQLVAEKQHPFQFPYNFHFQQITLGLAGKKPMLGELSYHVSLEVPATSTPTDEFGKVQQSSAIAQALMSGLSPEQQAIVLEPALTTQPEVIIPFFKTKYNIAYSDDASNPLNSLDTFMAKTELDSDAVEALLAMGGHTPYPSPNIQSAGQIAGGKPSHDEGAAAIVSRFGAGYVNGTAADPAMGLRKDIDGVVYLTNTSVDRFDRLQRMIRLQRWTGISFTALDTLVMAVVRSEGAVNPQMVLTVNTLRALGTYRYLNKRYGLAPGEFAAFVHQMPGEANDGRLPMFDRVFNNPALFDTPLVLDGSILDLDQDSSEHVKARAQLSRALHLSSTHEGLRQLAIDVRELIGNAPTDFRLNVSMISSLYRQARIASMFGLTTAQCRALIDLLGSLSFRKKVVSGQLDDTEPDVLDILMQLDWAVTWLEASDRDVTTLRRQAGWDMTETIVTQELTVQLEQLTNDARLAVVNSDQLASLDLPSKDDQNNTINWWLILSYLIDESGLVRTQPLHEEPAVSIRRTLHERLSAIAIAEPLASEVEARLATFVLNGYRNQHRLVEELLLTLTGLPPDRCEPVIRWAGSDVNKFLAALLWDNGVIQTLSTLIRYSEVSQQLGLSARALRTFLINPRWLYAGSEGPFSLSPNSLYLLDRYSNWRDNCGYPEEALLEYFKQANDPQRDATQCAARLASLTGWTSSEVLAANALLTGSDRIASNMHEVDWLSRMHSASDVTGLSARQLLSATDLTATSTASHWKSVGEAVIAANR

SEQ ID NO: 575 - protein, 980 aa, Pseudomonas Sp.
MNEQPFSLLRNLARSGDNTHKHDDGQVSFIDAMEKLNVHSVFDIVRRSKTAFVRELSRISDADAALAYENARCYATQIVRLYRNQLLSSGRTQQLTRRTGVRSLVDIGPGFPNLFKENWDLLCKVGAIEAKDSPVAYLTSLYRFALEQLEGSIAEDSRIKLHDRRPDLEDLLIDQQSTFTPIPTLHIVNQVLSKAISAYVDTVPADKNKSIYQLVAEKQHPFQFPYNFHFQQISLGLAGKKPTLGELSYRVSLEVPTTSGYGSDYGKVQHSSAIAQVLMSGAGPEQQSIVLEPALSSQANADTSADLTRQFFKTKYNVDYVDDASNPLNNLNVFLEKTGLDSDGVEALLAIGSHTAYASPNILSAKHTADEDSPLEASLKAIKARFGAGYVNGPTTQPAMATSKDAYGIERLINTSVDRFDRLQRMIRLQRWTGIPFSALDTLIMAVIRSEGSVNLPMVLTVNTLRALGTYRYLDKRYGLAPDEFAAFVHLMAGEANDGRLPMFDRVFNNPALFDTPLVLSGSILYLDHDSSQYVKARAQLSRALHLSSTHEGLRQLAIDVRELIGNAPTDFRLNLRMISSLYRQTRIASMLGLTALESRALIDLLGSESYRKKVISGQLDDTEPDVLDILMQLDWAVTWLKASDRDIATLRRQIGWDMTETIVTQELTVQLEQLTNDARQAVLKRDQLASLDLPSKDDQNNAITWWNILHVLIDLSGLVIPQPLAEDPAFSIRRTLHERLSHIAIGEPLLTEIEARLATFILNGYLNQHRLMEGLLLTLTGLPLDRCEPVIRWAGSDVSKFLGELLLGKGVIQTLTKLIRYSEVSQQLGLSARALRTFLINPRWLYPEVGFLLPLSMNSLYLLDRYRDWRDNCGYPEEALLEYFKQANDTPRDNTQCAARLASLTGWTSSEVLAANALLTGSDRIASNMHEVDWLSRMHNASDVTGLSAKQLLSATDLTATSTASHWKSVGEAVIAANR

SEQ ID NO: 576 - protein, 998 aa, Pseudomonas Sp.
MTLLSARRERHGKQGWVMTTGEPDMTEHPFSLLRNLARSGNDTHEHGDDTLSFINAMEKLNIHSVFDIVRRSKGAFVHELSRISDADAALAYENARCYATQIVRLYRNQLLSSGRTQQLTQRTGVRSLVDIGPGFPNLFKENWDLFCKVGAIEAKDSPVAYLTSLYRFALEQLEGSVAEPSRIKLDERRPDLKDLLIDHQSTFTPVPTLHIVNQVLSKAINAYVGTVPEDKGKTIYQLVAEKQHPFQFPYNFHFQQITLGLAGKKPMLGELSYHVSLEVPATSTPTDEFGKVQQSSAIAQALMSGLSPEQQAIVLEPALTTQPEVIIPFFKTKYNIAYSDDASNPLNSLDTFMAKTELDSDAVEALLAMGGHTPYPSPNIQSAGQIAGGKPSHDEGAAAIVSRFGAGYVNGTAADPAMGLRKDIDGVVYLTNTSVDRFDRLQRMIRLQRWTGIPFTALDTLVMAVIRSEGDVNPQMVLTVNTLRALGTYRYLNKRYGLAPGEFAAFVHQMPGEANDGRLPMFDRVFNNPALFDTPLVLDGSILDLDQDSSEHVKARAQLSRALHLSSTHEGLRQLAIDVSELIGNAPTDFRLNVSMISSLYRQARIASMFGLTTAQCRALIDLLGSLSFRKKVVSGQLDDTEPDVLDILMQLDWAVTWLEASDRDVTTLRRQAGWDMTETIVTQELTVQLEQLTNDARLAVVNSDQLASLDLPSKDDQNNTINWWLILSYLIDESGLVRTQPLHEEPAVSIRRTLHERLSAIAIAEPLASEVEARLATFVLNGYRNQHRLVEELLLTLTGLPPDRCEPVIRWAGSDVNKFLAALLWDNGVIETLSTLIRYSEVSQQLGLSAWALRTFLINPRWLHADFGGLLPLSMSSLYLLDRYRNWRDNCGYPEEALLEYFKQANDTPRDNTQCAARLASLTGWTSSEVLTANALLTGSDRIASSMHEVDWLSRMHSASDVTGLSARQLLSATDLTATSTASHWKSTGEAVIAANR

SEQ ID NO: 577 - protein, 1004 aa, Pseudomonas Sp.
MALLSGRRERHGRQSWVMITGEPDMNEQPFSLLRNLARSGDNTHKHDDGQVSFIDAMEKLNVHSVFDIVRRSKTAFVRELSRISDADAALAYENARCYATQIVRLYRNQLLSSGRTQQLTRRTGVRSLVDIGPGFPNLFKENWDLLCKVGAIEAKDSPVAYLTSLYRFALEQLEGSIAEDSRIKLHDRRPDLEDLLIDQQSTFTPIPTLHIVNQVLSKAISAYVDTVPADKNKSIYQLVAEKQHPFQFPYNFHFQQISLGLAGKKPTLGELSYRVSLEVPTTSGYGSDYGKVQHSSAIAQVLMSGAGPEQQSIVLEPALSSQANADTSADLTRQFFKTKYNVDYVDDASNPLNNLNVFLEKTGLDSDGVEALLAIGSHTAYASPNILSAKHTADEDSPLEASLKAIKARFGAGYVNGPTTQPAMATSKDAYGIERLINTSVDRFDRLQRMIRLQRWTGIPFSALDTLIMAVIRSEGSVNLPMVLTVNTLRALGTYRYLDKRYGLAPDEFAAFVHLMAGEANDGRLPMFDRVFNNPALFDTPLVLSGSILYLDHDSSQYVKARAQLSRALHLSSTHEGLRQLAIDVRELIGNAPTDFRLNLRMISSLYRQTRIASMLGLTALESRALIDLLGSESYRKKVISGQLDDTEPDVLDILMQLDWAVTWLKASDRDIATLRRQIGWDMTETIVTQELTVQLEQLTNDARQAVLKRDQLASLDLPSKDDQNNAITWWNILHVLIDLSGLVIPQPLAEDPAFSIRRTLHERLSHIAIGEPLLTEIEARLATFILNGYLNQHRLMEGLLLTLTGLPLDRCEPVIRWAGSDVSKFLGELLLGKGVIQTLTKLIRYSEVSQQLGLSARALRTFLINPRWLYPEVGFLLPLSMNSLYLLDRYRDWRDNCGYPEEALLEYFKQANDTPRDNTQCAARLASLTGWTSSEVLAANALLTGSDRIASNMHEVDWLSRMHNASDVTGLSAKQLLSATDLTATSTASHWKSVGEAVIAANR

SEQ ID NO: 578 - protein, 923 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQVPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVAETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVECRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYTALQQMRPSNNIETALDHVLSSVQISTAPARTTQLINQTKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPANMLIKASELKADSAFADWKSVGEAITSAYP

SEQ ID NO: 579 - protein, 923 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQAPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVTETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVGCRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYTALQQMRPSNNIETALDHVLSSVQISTAPARTTQLINQAKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPANMLIKASELKADSAFADWKSVGEAITSAYP

SEQ ID NO: 580 - protein, 926 aa, Pseudomonas Sp.
MVERSNALHQHTPALQLVDPRGLPVGSIALCRTSSDIEPQILTSHASFDMAGRPVSCWDSRLWADRAPANLSVIHSLSGQVLASDSVDAGWRVSLAGEAGQALVVWDARGVVRRIGYDALLRPIEVFEDEHCVGRLLYGGPDSTDHNQCGQLIRHDDPAGTRLDDAYGLSGNVIRQTRRFLHSADEPDWPESLTGRDALLEPGDGATTCWQYNPLSEITWQRDAQGNVQCLGYTVAGQLKDSRLQLNGQAEQVLVSAIQYDAQGRVVSETAGNGVISTALYAAEDGRLGELNTTRSNGQSLQDLRYDYDPVGNVIRVDDRALPAISKGQRIGSVSTYRYDTLYQLIEASGREWAVVNHGPVLPGFQSPADPSTLADYTQTYRYDAGGNLQQLTHTGTQSHSRTLVTARCSNRSLPVINGHIPDEAEIAAAFDANGNLLALQAGQNLSWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGSGTLELDGQAQRVSHERYYPFGGTSWWAGRNAIDASYKTVRYSGKERDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLDLRKGDETEIASALRGRRNVHISDIREEEFFRKFQKTPSYEIYKDLYGDDPRHYSAASDVLRYSLINHYGGIYSDTDDMFKRGVRDTDFITKPKRIFTMRPTDTPWSRDEIVINNNSFASPANNPVLSTLEKEIVDRYSVYRETGLGKVLSSTADVRDRMRIVSAVTGPKVFTEVLLKEGRGLRKLFSTMVNYHVKGEKLKNPKRYQAEAQKRMPLSNFIKMGGSHSWQ

SEQ ID NO: 581 - protein, 928 aa, custom Sp.
MVERSIALHQHTPALQLVDPRGLPVGSIALCRTSSDIEPQIRTSHASFDMAGRPVSCWDPRLWADRAPANLSVIHSLSGQVLASDSVDAGWQVLLAGEAGQVLEAWDARGVVRRTGYDALLRPIKVFEDEHCVERLLYGGPDSSTYNQCGQLIRHDDPAGTRLDDAYGLSGNVIRQTRRFLHSADEPDWPESLTGRDALLEPGDGATTCWQYNPLSEITWQRDAQGNVQCLGYTVAGQLKDSRLQLNGQAEQVLVSAIQYDAQGRVVSETAGNGVISTALYATEDGRLGELNTTRSNGQSLQDLRYDYDPVGNVIRVDDRALPAISKGQRIDSVSTYRYDTLYQLIEASGREWAVVNHGPVLPGFQSPADPSTLADYTQTYRYDAGGNLQQLTHTGTQSHSRTLVTARCSNRSLPVINGHIPDEAEIAAAFDANGNLLALQAGQNLSWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGSGTLELDGQAQRVSHERYYPFGGTSWWAGRNAIEASYKTVRYSGKGRDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLHLDLRKGDETEIASALRGRRNVHISDLREEEFFRKFQKTPSYEIYKDLYGDDPRHYSAASDVLRYSLINHYGGIYSDTDDMFKRGVRDTDFITKPKRIFTMRPTDTPWNRDEIVINNNSFASPANNPVLSTLEKEIVDRYSVYRETGLGKVLSSTADVSDRMRIVSAVTGPKVFTEVLLKEGRGLRKLFSTMVNYHVKGEKLKNPKRYQAEAQKRMPLSNFIKMGGSHSWQ

SEQ ID NO: 582 - protein, 926 aa, Pseudomonas Sp.
MVERSIALHQHTPALQLVDPRGLPVGSIALCRTSSDIEPQIRTSHASFDMAGRPVSCWDPRLWADRAPANLSVIHSLSGQVLASDSVDAGWQVLLAGEAGQVLEAWDARGVVRRTGYDALLRPIKVFEDEHCVERLLYGGPDSITYNQCGQLIRHDDPAGTRLDDAYGLSGNVIRQTRRFLHSADEPDWPESLTGRDALLEPGAGATTCWQYNPLSEITWQRDAQGSVQCLGYTVAGQLKDSRLQLNGQAEQVLVSAIQYDAQGRVVSETAGNGVISTALYATEDGRLGELNTTRSNGQSLQDLRYDYDPVGNVIRVDDRALPAISKGQRIDSVSTYRYDTLYQLIEASGREWAVVNHGPVLPGFQSPADPSTLADYTQTYRYDAGGNLQQLTHTGTQSHSRTLVTARCSNRSLPVINGHIPDEAEIAAAFDANGNLLALQAGQNLSWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGAGTLELDGQAQRVSHERYYPFGGTSWWAGRNAIDASYKTVRYSGKERDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLDLRKGDETEIASALRGRRNVHISDLREEEFFRKFQKTPSYEIYKDLYGDDPRHYSAASDVLRYSLINHYGGIYSDTDDMFKRGVRDTDFITKPKRIFTMRPTDTPWNRDEIVINNNSFASPANNPVLSTLEKEIVDRYSVYRETGLGKVLSSTADVSDRMRIVSAVTGPKVFTEVLLKEGRGLRKLFSTMVNYHVKGEKLKNPKRYQAEAQKRMPLSNFIKMGGSHSWQ

SEQ ID NO: 583 - protein, 926 aa, Pseudomonas Sp.
MVERSIALHQHTPALQLVDPRGLPVGSIALCRTSSDIEPQIRTSHASFDMAGRPVSCWDPRLWADRAPANLSVIHSLSGQVLASDSVDAGWRVLLAGEAGQVLEAWDARGVARLTGYDALLRPIEVFEDEHCVERLLYGGPDSIAYNQCGQLIRHDDPAGTRLDYAYGLSGSVISQTRRFLQNLDEPDWPESLTGRDALLELGEGATTRWRYNSVNETLRQTDAQGNVQCLGYTVAGQLKDSRLQLNGQAEQVLVSAIQYDAQGRVVSETAGNGVISTARYDTEDGRLLALNATRSNGQLLQDLRYDYDPVGNVIRVDDRALPAISKGQRIDSVSTYQYDTLYQLIEASGSEWAVVNHGPVLPGFQSPADPSTLADYTQTYRYDAGGNLQQLTHTGTQSHSRTLVTARCSNRSLPVINGHIPDEAEIAAAFDANGNLLALQAGQDLSWDRRNQLQYVRPVVRENGSDDSERYSYDASGQRLRKVRTTQAKTMTHTADVRYLPGLEIRTDTATGETLHVVVAQAGRNNVRVLHWASGKPDALENDQTRYTLNDHLGSGTLELDGQAQRVSHERYYPFGGTSWWAGRNAIEASYKTVRYSGKERDATGLYYYGMRYYAPWLQRWINPDPAGLEDGLNLYGMLRNNPLTFIDALGRVAEIPKHIHYIWLGAAEPLMEHLEGIKNTSVLNPDYQLTLHLHLDLRKGDETEIASALRGRRNVHISDLREEEFFRKFQKTPSYEIYKDLYGDDPRHYSAASDVLRYSLINHYGGIYSDTDDMFKRGVMDTDFITKPKRIFTMRPTDTPWNRDEIVINNNSFASPANNPVLSTLEKEIVDRYSVYRETGLGEVLSSTADVNDRMRIVSAVTGPRVFTEVLLKEGRGLSKLFTTMIDHHIKGKPLKNPKRYQAEAQKRMPLSNFIKMGGSHSWQ

SEQ ID NO: 584 - protein, 982 aa, Pseudomonas Sp.
MGQALTNGQGIDAESAAVCPCCATGISVSRRYGATYLECGTARNFPAPSDLLQVPVMVERSNALHQHTPALQLVDPRGLPVGSIALCRTSSDIEPQIRTSHASFDMAGRPVSCWDPRLWADRAPANLSVIHSLSGQVLASDSVDAGWQVLLAGEAGQVLEAWDARGVVRRTGYDALLRPIKVFEDEHCVERLLYGGPDSSTYNQCGQLIRHDDPAGTRLDDAYGLSGNVIRQTRRFLHSADEPDWPESLTGRDALLEPGDGATTCWQYNPVSEITWQRDAQGNVQCLGYTVAGQLKDSRLQLNGQAEQVLVSAIQYDAQGRVVSETAGNGVISTALYATEDGRLGELNTTRSNGQSLQDLRYDYDPVGNVIRVDDRALPAISKGQRIDSVSTYRYDTLYQLIEASGREWAVVNHGPVLPGFQSPADPSTLADYTQTYRYDAGGNLQQLTHTGTQSHSRTLVTARCSNRSLPVINGHIPDEAEIAAAFDATGNLLALQAGQNLRWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGSGTLELDGQAQRVSHERYYPFGGTSWWAGRNAIEASYKTVRYSGKERDATGLYYYGLRYYAPWLQRWINPDPAGLEDGLNLYGMLRNNPLTFIDAVGGVAEIPKHIHYIWLGAAEPLMERLEGIKNTSVLNPDYQLTLHLHLDLRKGDETEIASALRGRRNVHISDLREEEFFRKFQKTPSYEIYKDLYGDDPRHYSAASDVLRYSLINHYGGIYSDTDDMFKRGVRDTDFITKPKRIFTMRPTDTPWNRDEIVINNNSFASPANNPVLSTLEKEIVDRYSVYRETGLGKVLSSTADVSDRMRIVSAVTGPKVFTEVLLKEGRGLRKLFSTMVDYHVKGEKLKNPKRYQAEAQKRMPLSNFIKMGGSHSWQ

SEQ ID NO: 585 - protein, 929 aa, Pseudomonas Sp.
MVERSIALHQHTPALQLVDPRGLPVASILLHRSSIDHEPELRTSQASFDLASRPVSHWDPRLWADRAPANLSVIHSLGGRVLASDSVDAGWRVLLAGEAGQVVEAWDARGVVRRTQYDALLRPTEVFEDEHCVERLLYGGPDSTAYNQCGQLIRHDDPAGTRLDDAYGLSGSVIRQTRRFLHSANEPDWPASLAGRDALLEPGDGATTCWHYNPLNETIRQIDAQGNVQLLDYTVAGQLKNSRLQLNCQAEQVLVSAIQYDAQQRVVSETAGNGVISTALYATEDGRLLELNARHGNGPMLQDLLYGYDPVGNVIRIEDRAQSTAYNRNQRIDPVSAYGYDTLYQLIEATGRESAVVNHGPVFPGFQSPADPAQLANYTQTYRYDAGGNLQQLTHTGAQSHSRTLVTARYSNRSLPVINDHIPGEAEIAAAFDANGNLLALQAGQDLSWDRRNQLQQVRPVVRESGNDDSERYSYDASGQRLRKVRTTQAKTITHTADVRYLPGLEVRTDSVTGETLHVVVAQAGRNNVRVLHWASGKPDVLENDQTRYTLNDHLGSGTLELDGQAQRVSQESYYPFGGTSWWAGRSAIEASYKTVRYSGKERDATGLYYYGMRYYAPWLQRWINPDPAGLEDGLNLYGMLRNNPLTFIDAAGEVAEIPKHIHYIWLGAAEPLMKHLGGIENTSVLNPDYQLTLHLHLHLDLRKGDETEIVAALRGRRNVHISDLREEEFFRKFQKTPSYEIYKDLYGDDPRHYSAASDVLRYSLINHYGGIYSDTDDMFKRGVRDTDFIPKPKRIFTMRPTDTPWNRDEIVINNNSFASPANNPVLSTLEKEIVDRYSVYRETGLGAVLSSTADVNDRMRIVSAVTGPRVFTEVLLKEGRGLSKLFSTMIDHHIKGKPLKNPKRYQAEAQKRMPLSNFINMGGSHSWK

SEQ ID NO: 586 - protein, 927 aa, Pseudomonas Sp.
MVERSIALHQHTPALQLVDPRGLPVASILLHRSSIDHEPELRTSQASFDLASRPVSHWDPRLWADRAPANLSVIHSLGGRVLASDSVDAGWRVLLAGEAGQVVEAWDARGVVRRTQYDALLRPTEVFEDEHCVERLLYGGPDSTAYNQCGQLIRHDDPAGTRLDDAYGLSGSVIRQTRRFLHSANEPDWPASMAGRDVLLEPGDGATTCWHYNPLNETIRQIDAQGNVQLLDYTVAGQLKNSRLQLNCQAEQVLVSAIQYDAQQRVVSETAGNGVISTALYATEDGRLLALSARRADGLMLQDLLYDYDPVGNVIRIEDRAQSTAYNRNQRIDPVSAYGYDTLYQLIEATGRESAVVNHGPVFPGFQSPADPAQLANYTQTYRYDAGGNLQQLTHTGAQSHSRTLVTARYSNRSLPVINDHIPDEAEIAAAFDANGNLLALQAGQNLSWDRRNQLQQVRPVVRDDAADDSERYIYDASGQRLRKVRTTQAKTITHTADVRYLPGLEIRTDTATGETLHVVVAQAGRNNVRVLHWASGKPDALENDQTRYTVNDHLGSGTLELDAQGQLISQESYYPFGGTSWWAGRNAIEANYKTVRYSGKERDATGLYYYGMRYYAPWLQRWINPDPAGLEDGLNLYGMLRNNPLTFIDAAGEVAEIPKHIHYIWLGAAEPLMKHLGGIENTSVLNPDYQLTLHLHLDLRKGDETEIVAALRGRRNVHISDLREEEFFRKFQKTPSYEIYKDLYGDDPRHYSAASDVLRYSLINHYGGIYSDTDDMFKRGVRDTDFIPKPKRIFTMRPTDTPWNRDEIVINNNSFASPANNPVLSTLEKEIVDRYSVYRETGLGAVLSSTADVNDRMRIVSAVTGPRVFTEVLLKEGRGLSKLFSTMIDHHIKGKPLKNPKRYQAEAQKRMPLSNFINMGGSHSWK

SEQ ID NO: 587 - protein, 927 aa, Pseudomonas Sp.
MVERSIALHQHTPALQLVDPRGLPVVSIALCRASSDIEPQILGSHASFDMAGRPVSHWDPRLWADRAPANLSVIHSLSGRVLASDSVDAGWRVLLAGEAGQVLEAWDGRGIVRRTQYDALLRPTEVFEDEHCVERLLYGGPDATAYNQCGQLIRHDDPAGTLLDDAYGLSGSVIRQTRRFLHAVDEPDWPESLTGRDALLEPGDGATTHWRYNPLNETTRQTDAQGNVQSLDYTIAGQLKDSRLQLNGQAEQVLVSAIQYDAQGRVVSETAGNGVISTALYATEDGRLLELNARRANGPMLQDLLYDYDPVGNVIRIEDRAQPTVYSGNQRIDPVSTYQYDTLYQLIEATGRESSVVNHGPVLPGFQSPADPTQLANYTQTYRYDAGGNLQQLTHSGAQSHSRTLVTARYSNRSLPVINNHKPEEAEIAAAFDANGNLLALQAGQDLSWDRRNQLQQVRPVIRESGNDDSERYSYDASGQRLRKVRTTQAKAVTHIADVRYLPGLEIRTDSATDEALHVVVAQGGRNSARVLHWQTGKPDAIKNDQIRYTLSDHLGSGPLELDAQGRLISQESYYPFGGTSWWTGRNIIEASYKTVRYSGKERDATGLYYYGLRYYAPWLQRWINPDPAGIEDGLNLYGMLRNNPLTFIDAGGGVAEIPKHIHYIWLGAPEPLMKHLKGIENTSVLNPDYQMTLHLHMDLRKGDETEIVSALRGRRNVHISNLREEEFFKKFQKTPSYEIYKDLYGDDPRHYSAASDVLRYSLINHYGGIYSDTDDSFTRGIRDSDFITKHNRVFTLYPTDTPWNRSEFVLNNSSFASPAKNPVLSSLEKEVVSRYSVYRETGLGKVLSSTADVNDRMRIVSAVTGPRVFTDVLLREGRGLKKLFSTMINHHVKGEKLKNPERHHAETEKRMPLSRFVKMGSSHSWR

SEQ ID NO: 588 - protein, 880 aa, Pseudomonas Sp.
MVERSIALHQHTPALQLVDPRGLPVVSIALCRASSDIEPQILGSHASFDMAGRPVSRWDPRLWADRAPASLSVIHSLSGQVLASDSVDAGWRVLLAGEAGQVLEAWDGRGIVRRTQYDALLRPTEVFEDEHCVERLLYGGPDATAYNQCGQLIRHDDPAGTLLDDAYGLSGSVIRQTRRFLHAVDEPDWPESLTGRDALLEPHEGATTHWRYNPLNETTRQTDAQGNVQSLDYTVAGQLRGTRLLLNGLAENVLVSAIEYDAQERVVSETAGNGVVSTALYATEDGRLLELNARRADGPMLQDLLYDYDPVGNVIRIEDRAQPTVYSGNQRIAPVSTYQYDTLYQLIEATGRESSVVNHGPVLPGFQSPADPTQLANYTQTYRYDAGGNLQQLTHTGAQSHSRTLVTARYSNRSLPVINDHIPDEAEIAAAFDANGNLLALQAGQDLSWDRRNQLQQVRPVIRESGNDDSERYSYDASGQRLRKVRTTQAKAVTHIADVRYLPGLEIRTDSATGETLHVVIAQGGRNNVRVLHWASGKPDALENDQTRYTLNDHLGCGTLELDAQGQLISQESYYPFGGTSWWAGRNAIEANYKTVHYSGKERDATGLYYYGLRYYAPWLQRWINPDPAGIEDGLNLYGTLRNNPLTFIDAGGGVADIPKHIHYIWLGAPEPLMKHLKGIENTSVLNPDYQMTLHLHMDLRKGDETEIVSALRGRRNVHISNLREEEFFKKFQKTPSYEIYKDLYGDDPRHYSAASDVLRYSLINHYGGIYSDTDDSFTRGIRDSDFITKHNRVFTLYPTDTPWNRSEFVLNNSSFASPAKNPVLSSLEKEVVSRYSVYRETGLGKVLSSTADVNDRMRIVSAVTGPECSRTCCSGKGVG

SEQ ID NO: 589 - protein, 743 aa, Pseudomonas Sp.
MVKRSIALHQHTPALQLVDPRGLPVGSIALCRTSSDIEPQIRTSHASFDMAGRPVSCWDPRLWADRATANLSVIHSLSGQVLASDSVDAGWRVLLAGEAGQVLKAWDARGIVRRTGYDALLRPIEVFEDGHCVERLLYGGPDSTDHNQCGQLIRHDDPAGTRLDDEFGLSGSVISQTRRFLQNLDEPDWPESLTGRDALLELGEGATTRWRYNSVNETLRQTDAQGNVQCLGYTVAGQLKDSRLQLNGQAEQVLVSAIQYDAQERVVSETAGNGVMSTARYDTEDGRLLALNATRSNGQLLQDLRYDYDPVGNVIRVDDFALPAISKGQRIDSVSTYRYDTLYQLIEASGREWAVVNHGPVLPGFQSPADPSTLADYTQTYRYDAGGNLQQLTHTGTQSHSRTLVTAHYSNRSLPVINGHIPDEAEIAAAFDANGNLLALQAGQDLSWDRRNQLQHVRPVIRDNGMDDSERYSYDASGQRLRKVRTTQAKTMTHTADVRYLPGLEIRTDTATGETLHVVVAQAGRNNVRVLHWASGKPDALENDQTRYTLNDHLGSGTLELDGQAQRISQESYYPFGGTSWWAGRNAIEASYKTVRYSGKERDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLDLRKGDETEIASALRGRKNVHISDLREEEFFRKFQKTPSYEIYKDL

SEQ ID NO: 590 - protein, 923 aa, custom Sp.
MVETLLALHARTPSLHAMDPRQRLIHSIAFCRLTPDDEPEVRISHTVFDVAGRPSMSWDARLWADRAPANVTNIHTLSGQVVASESVDAGWRVSLAGDAGQEVSAWDGRGVARRTRYDAQLRPTHVFEDQHCVERLLYGGAESASRNQCGQLIRHDDPAGTQLEDEYSLSGHVLSQTRRFLKNHDRPNWPESLAARDALLEIGAGATTCWHCNPLSETLRQTDAQGNVQSLDYTLAGQLKSSRLRLHGQAEKVLVSQLQYDAQQRVVSETAGNGVISTARYGTEDGRLLELKARRGNGEVLQDLLYDYDPVGNVIRIEDRAQPTAYNGIQRIDPVSTYRYDTLYQLVEASGRESAVVNQGPVSAGFQRLADPAKLSRYTQIYRYDAGGNLQQLTHHGAQPRSSKRVTARYSNRSLPVINDRIPDETEIAAAFDSNGNLLALQAGQDVNWDPRNQLQKVRPVIRENAMDDSECYVYDASGQRLRKVRMTQAKTVVHSAEVRYLPGLEVRTDSATGETLHVVVAQGGRNNVRVLHWQAGKPDTLENDSIRYTLNDHLGSSALELDAQAQLISQESYYPFGGTSWWAGRSAIEANYKTVRYSGKERDATGLYYYGLRYYAPWLQRWINPDPAGEGLNLYGMLSNNPLTFIDAQGGVAEIPEHIHYIWLGKAAPLMKHLSGIRRNAVVNPDYQLTLHLHLRSGNESRIASALHEEKNVKISDLREEAFFKRFKETASYNIYTDLYGDDPRHYAAASDVLRYSLINYYGGIYSDTDDTFMRGFRKTDFKTKPKRVFTLDAMATPWNSSEIVIPNSTFASHAKNPVLSALENEVVSRYSDYRETGLGHILSSTADVGDRMKIVSDVTGPKVFTEVLLKEGRGLRKLFSLMVNHNIHHEKLSSPKSYQKEIKKRMPFSYIVEIGNSHSWR

SEQ ID NO: 591 - protein, 470 aa, custom Sp.
MMLRPSVLNRRRFLGLAALGGTGLALPTTSLAQHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVYEQQLQATAKAHPHDGGRHRNEPLASVYTLRSQLQISLGDMRDCWAYFDTARYPDAIQVRLDRELFSMLIGSYYDDRVPEPATVTLPVPPTGPIRSITLQGYVFVDGLTLSYAAGQGPDRVDAVHVGGAGGAFFSIDDIVERGHVRAVLVQHGYAVDRLGLEYGDGTLSGTVGNTGNQDPAARLAFPGHHLSSVIGFGTAAGYGGVLSGCMFGFQLDEPSAPVAFDRRVQDRLQRVWPSGLQAALRRSAQG

SEQ ID NO: 592 - protein, 470 aa, custom Sp.
MMLRPSVLNRRRFLGLAALGGTGLALPTTSLAQHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVVEQQLQATAKAHPHDGGRHRNEPLASVYTLRSQLQISLGDMRDCWAYFDTARYPDAIQVRLDRELFSMLIGSYYDDRVPEPATVTLPVPPTKAITKIELWGYVFVDGLTLSYAAGQGPDRVDAVHVGGAGGAFFSIDDIVERGHVRAVLVQHGYAVDRLGLEYGDGTLSGTVGNTGNQDPAARLAFPGHHLSSVIGFGTAAGYGGVLSGCMFGFQLDEPSAPVAFDRRVQDRLQRVWPSGLQAALRRSAQG

SEQ ID NO: 593 - protein, 470 aa, custom Sp.
MMLRPSVLNRRRFLGLAALGGTGLALPTTSLAQHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVYEQGLQATAKAHPHDGGRHRNEPLASVYTLRSEMTISLGDMRDCWAYFDTARYPDAIQVYLDRELFSMLIGSYYDDRVPEPATVTLPSPPTKAITKIELWGYVFVDGLTLSYAAGQGPDRVDAVHVGGAGGAFFSIDDIVERGHVRAVLVQHGYAVDRLWLEYGDGTLSGTVGNTGNQDPAARLAFPGHHLSSVIGFGTAAGYGGVLSGCMFGFQLDEPSAPVAFDRRVQDRLQRVWPSGLQAALRRSAQG

SEQ ID NO: 594 - protein, 419 aa, Photorhabdus Sp.
MQTENVLDIRTIVANEYAIKTSALEWDVTDIVKNAIIGGISFIPTVGPAISFLVGLFWPQSKENIWEGIVKQIERMIEESALKTIKGILAGDIAYIQERMATVADLLEKHPGSAEARSAFNNLAENIDGYHKKFNNFSDDVNYQILPMFSTTVMMQITYWVAGLERKDEIGLSDIDIEKVRGLIKKTVEQANNYINNIYGRELNDALNNSTADTVANNVMSVHGHCRLHGIEYISIWDRLSETESVNNRIYVDVLSYSTFFDRQTAKARIQALTPEKDMAPPLKPALNGGKRRKINSLMGHIVRIGGAPRVGGLTVIFDDGSRHQLGTISGETASISLDGNRITSLEVWGNGAVDKAVFTLSDGRSLSFGAPGTSRYRKFYVGESHYISGIYLSSDYSPLAGQAANIAVSYQLINDDEK

SEQ ID NO: 595 - protein, 419 aa, Photorhabdus Sp.
MQTENVLDIRTIVANEYAVKTSALEWDVTDIVKNAIIGGISFIPSVGPAISFLVGLFWPQSKENIWEGIVKQIERMIEESALKTIKGILAGDIAYIQERMATVADLLDKHPGSEEARSAFNNLAENIDGYHKKFNNFSDDVNYQILPMFSTTVMMQITYWVAGLERKDEIGLSNIDIEKVRGLIKKTVEQANSYINNIYDRELNDALNNSTADTVANNVMSVHGHCRLHGIEYISIWDRLSEAESVNNRIYVDVLSYSTFFDRQTAKARIQALTPEKDMTPPLKPALNGGKRRRIDSLTGHIVRIGGAARVGGLTVVFDDGSRHQLGTISGETSSISLNGSRITSLEVWGNGAVDQAVFTLRDGRSLSLGSPGTSRYRKFYVGESHYIAGIYLSSDYSPLAGQAANIAVSYQLINDDEK

SEQ ID NO: 596 - protein, 419 aa, Photorhabdus Sp.
MQTENVLDIRTIVANEYAVKTSALEWDVTDIVKNAIIGGISFIPSVGPAISFLVGLFWPQSKENIWEGIVKQIERMIEESALKTIKGILAGDIAYIQERMATVADLLDKHPGSEEARSAFNNLAENIDGYHKKFNNFSDDVNYQILPMFSTTVMMQITYWVAGLERKDEIGLSNIDIEKVRGLIKKTVEQANSYINNIYDRELNDALNNSTADTVANNVMSVHGHCRLHGIEYISIWDRLSEAESVNNRIYVDVLSYSTFFDRQTAKARIQALTPEKDMTPPLKPALNGGKRRKIDSLTGHIVRIGGAARVGGLTVVFDDGSRHQLGTISSETSSISLNGSRITSLEVWGNGAVDQAVFTLRDGRSLSLGSPGTSRYRKFHVGESHYIAGIYLSSDYSPLAGQAANIAVSYQLINDDER

SEQ ID NO: 597 - protein, 420 aa, Photorhabdus Sp.
MMHTENVLDIRTIVANEYVVKTSALEWDVTDIVKNAIIGGISFIPSVGPAISFLVGLFWPQSKENIWEGIVKQIERMIEESALKTIKGILAGDIAYIQERMATVADLLDKHPGSDEARSAFNNLAENIDGYHKKFNNFSDDVNYQILPMFSTTVMMQITYWVAGLERRAEIGLSDIDIEKVRGLIKKTVEQANSYINSIYDRELNDALNNSTADTVANNVMSVHGHCRLHGIEYISIWDRLSESESVNNRIYVDVLSYSTFFDRQTAKARIQALTPEQDMAPPLKPALNGGKRRKIDSLMGHIVRIGGAPRVGGLTVVFDDGSSHRLGTISGETASISLNGSRITSLEVWGNGAVDRAVFTLSDGRFLLFGDPGTSRYRKFYVGDSHYISGIYLSSDYNPLAGQAANIAVSYQLINDDEK

SEQ ID NO: 598 - protein, 133 aa, Photorhabdus Sp.
MSRITIFIDSDEQKSEFNSDSPVPVRKDLNTVVPLSDLTISPRSSVEVFRIDTPIIPESRRSLRVVNTGLASSVTAKFYWSHSFTSEWFESGSIDVGLGEDKVLNVPNNSFYYSKFVIYNNTDKVAYITANLV

SEQ ID NO: 599 - protein, 133 aa, Photorhabdus Sp.
MSRITIVVDSDEQKAEVYSNSPVPVHKDLNAVGPLSELTISPHASVEVFRIDTPIIPESRKSLRVVNTGLANSVTAKFYWSHSFTSEWFESGSIDVGLGEDKVLNVPSNSFYYSKFVIYNNSDKVAYVTANLV

SEQ ID NO: 600 - protein, 133 aa, Photorhabdus Sp.
MSRITIVVDSDEQKAEVYSNSPVPVHKDLNAVGPLSDVTISPHASVEVFRIDTPIIPESRRSLRVVNTGLANSVTAKFYWSHSFTSEWFESGSIDVGLGEEKVLNVPNNSFYYSKFVIYNNTDKVAYVTANLV

SEQ ID NO: 601 - protein, 133 aa, Photorhabdus Sp.
MSRITIVVDSDEQKAEFYSNSPVPVHKDLNAVGPLSDVTISPHASVEVFRIDTPIIPESRRSLRVVNTGLSNSVTAKFYWSHSFTSEWFESGSIDVGLGEEKVLNVPNNSFYYSKFVIYNNTDKVAYVTANLV

SEQ ID NO: 602 - protein, 133 aa, Photorhabdus Sp.
MSRITIVVDSDTQKAEVYSNSPVPVHRDLNAVGPLSDVTISPHASVEVFRIDTPIIPESRSSLRVVNTGLANSVTAKFYWSHSFTSEWFEAGSIDVGLGEDKVLNVPSSSFYYSKFVIYNNTDRVAYVTANLV

SEQ ID NO: 603 - protein, 1094 aa, Bacillus Sp.
MADMWVLDRYDNPLAILSSDAEDDACTFHSDQFLEKLNQGTEFSFSCDARHEDSLHVTKLNQVVFRDEDGFFRLFKIREIDRGNGDNGAEKIAHCEPAEMELLEAIVEDVRPTGKTQQYALDRVLEGTRWKGNVTAQTGTQSTNFYHISAYEAITKIIEVWGGELRFTVNFDEENNKIIERVVNIEQRRGNDEGDRFEVGYNVDSITVTEMAYPVSALYGWGGSVETENGGDSRYIDFADVEWKVSNGDPADKPKGQKWIELPGAKEKYGYKKSDGAFISSFGQWQDENITDPKELLQKTYEHLRDTASKPQATYELKVIPTDHISLGDTRTAIDDTQADPIQIQSRVIALGYSISNPAGTKTVEMGEFLEVYQPDRRLDDLEDKVKNIDRNVQVTDGSFPDIVPSVPSNVTVKGLFSGVSITWDYDPSSYIAAYEVYGSQIKGFTPSIENRLWRGKQSGYLHENAGVDNVWYYRIRAVNYHSKASEFTAEFSAKTQRIMTDDILFGAITADKLANLAVTADAISRNFEEANILPGSLLRLSDILRVDSRVSVNEVNGFNELSVTKDTTEYTSFGFTTGGRNSLKLTKGETYTLSFELKRETLNDFSYIQVRSKSGTQYNLTNNFTDLSSYPTDEFVRFDLPFVSPATLTDGRVCLGGRTQNLTDNANFTIRKVQIRRGNVRMPFGFSPYDTQLTDGAVTSAIIADAAITSAKVAEAAIGTAAIQNAAIARALLQKAIIATVHIADAAITSAKIKELSADLITSGTINAINITGSLIRGGKFQALNTNSNFDSYFDGDKLYQYKMNSKSQYTKLDISSSLIYQEAGADYSIDGSKPEIWRSVSIGNGKVSVKGSGEFTNASNMAVVGMYGDFNGYGDGIGKFVIRNETNTSVPSDIFTLEGGYRPMNGTGGEQNYFSNFKNRAEITGSSTLASFQTSDFEAYVSGGLRFRSTKRTVFEGAPVELPKKSTIMPGDDQFTTPEKIVGGNVTSLVTDIHGALQNNLCINVSQCTVTVGSGSYGYGYVSYPMVDGNNQGAENVFAVMATPYGKNANNVTAGIMNQTANGFQVHVRGTGAKDVTNERITVRLVIFYEKK

SEQ ID NO: 604 - protein, 1100 aa, Bacillus Sp.
MADMWVLDRYDNPLAILSSDAEDDACTFYSDLFREELNQGAEFSFSCDARHEDSLHVTKLNQVVFRDEDGFFRLFKIREIDRGNGDNGAEKIAHCEPAEMELLEAIVEDVRPTDKTQQYALDRVLEGTRWTGKVTAQTGTQSTNFYHISAYEAITKIIEVWGGELRFTVNFDEENNKIIERVVNIEQRRGNDEGDRFEVGFNVESINVTDMAYPVSAMYGWGGSVETENGGDSRFIDFADVEWKVSNGDPADKPKGQNWVELPGAKEKYGYKKADGTFINSFGQWQDENITEPKELLQKTFEYLENTASKPQATYELKVIPTDKISLGDTRTAIDDTQAEPIQIQSRVIALEYAVSDPDSTKTVEMGEFLEVYQPDRRLDDLEEKVNNIDRNVKVTDGSFPDIIPKVPSNVTVKGLFSGVSITWDYDPSSYIAAYEVYGSQTTGFTPSIENRLWRGKQSGFLHENAGVDNVWYYRIRAVNYHSKASEFTAEFSAKTQRIMTDDILFGAITADKLADLTITAEKLSTTLQGQNLLPGSMLRNYDETYRLNASTRYLDTSKEFNEMRIVKTRTDEPLFGMTFTPRSKLNLSNGMTYTLSFELKRSTISNFSYLRIRVDGKEVYAIPNNLSDISSADPDQFLRYDVVFTPNITITNGALWIGATTANATDPGEFTIRKIQVREGDVRKEFTFSPYDTQLIDGAVTSAIIQDAAITSAKVAEAAIGTAAIQNAAIARAHLQEAIIDTVHIADAAITSAKIKELSADLITSGTIKAINITGSLIRGGKFQALNTNNNFDSYFDGDKLYQYRRSTASGTYGEYTKLDVQSSLIYQESGYVDSDGSNQEIYRSVSIGDGKISVKGTGRTSTESDVPVVEMYGSKGSGTTGVQGIIEISNESPTNRPKDIFTLTGEVSSIDIDELNYFSSFQNRARVSGSSTLLELKPSNAEIDVSGGLRVKASKRTVFEGAPVELPKKSTIMPGDDQFTTQEKIVGGNVTSLVTDIHGALQNNLLVCITQIDVALGASGGAYAYAYKWYNMVDGNSQGAENIFAVMATPYGKNANNVTVGIMSQSSEKFAVHVRGTGATDVAATTVTIRLAIFYEKA

SEQ ID NO: 605 - protein, 1124 aa, Bacillus Sp.
MADMWVLDRYDNPLAILSSDAEDDACTFHSDQFLEKLNQGTEFTFSCDARHEDSLHVTKLNQVVFRDEDGFFRLFKIREIDRGNGDNGAEKIAHCEPAEMELLEAIVEDVRPTGKTQQYALDRVLEGTRWKGNVTAQTGTQSTNFYHISAYEAITKIIEVWGGELRFTVNFDEENNKIIERVVNIEQRRGNDEGDRFEVGYNVESITVTEMAYPVSALYGWGGSVETENGGDSRYIDFADVEWKVSNGDPADKPKGQKWIELPGAKEKYGYKKADGTFINSFGQWQDENITDPKELLQKTYEYLRDTASKSQATYELKVIPTDHISLGDTRTAIDDTQADPIQIQSRVIALGYSISNPASTKTVEMGEFLEVYQPDRRLDDLEDKVKNIDRNVQVTDGSFPDIIPKVPSNVTVKGLFSGTSITWDYDPSSYIAAYEVYGSQIKGFIPSIENRLWRGKQSGYLHENAGVDNVWYYRIRAVNYHGKASEFTAEFSAKTQRILTDDIMFNSIIADRLANLAVTADKLARNFDQGNIFPGSLLKAKWFYDYTYTSHTVEEKEFNEMTVSQTQLTDQLFFGVCGLRIAPNNIQRMKLEQGKTYTLSFEVKRNNTTDLNYIHLKETNSWYRISGTDLSDISSYPSDQFVRVNIKFTAPTTSSVYTIGIGGFNRNNNTELCSFVIRKLQVREGDTIKEYGYSPYDTQLTDNVIDGDYIQALSIGSAHIQEAAIGTAHIQKAAITSAQIAEAAIGTAAIQNAAIAKAHLKTAIIDTVHIIDGAITNAKIGSLSADKINSGTINSINITGSLIKGGKFQALNTNRDFDSYFDGDKLYQYRRSTASGTYGEYTKLDVQSSLIYQESGYVDSDGSNQEIYRSVSIGDGKISVKGTGRTSTESDVPVVEMYGSKGSGTTGVQGIIAISNESPTNRPKDIFTLTGEVSSIDIDELNYFSSFQNRARISGSSTLLELKPSNAEIDVSGGIRMKSSKRTIFEGAPVELPKSSIIYPGDSQYTTAEKIVGGNVTSLVTDIHGELQNNMCICVTQCDVVLTSGGSYAYGYTTINFVDGNSQGAENIFAVMATPYGSNANNVTAGIMSQSSKGFQVHVRGTGAKDMTSASITVRLVVFYEKT

SEQ ID NO: 606 - protein, 986 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPYPKWIAESDNEQGGYYQDSFVPTYRMILRFVPR

SEQ ID NO: 607 - protein, 986 aa, Enterococcus Sp.
MKSKINSKKIIILMTVLVILLTHLPFHFAYGSETSELAPESQNDPSLGVERNATITFETSPSEGGRPSYIPHITPPGGDLLYTISANPNQGFRFVRWELINGWNASIGNLNAETTSLTISTDGPIGPPVHETITIRAIYERVYNLTFQSSPNAGGNPRADQTILAQGETTTIHANVSNGYRFVQWELVSGNTTIANRTSQSTFITMGAGDSSIRAVYEQITHSVSVQANPTIGGNPTVSASSAAQGATINLNANPAVGYRFVNWQFLTQNGATITNSNLANTSLRMGTGPVSVQANYERLQQGSVVVRYVDEEGNEIAQSDILTGFSGEAYRTEAKEIEGWELLVAPENATGVFTNVEQIVTYTYRKNQQLWGTVPWEYDEATKTIHLYGGIGGSVPEAPWKSHSEVETIIVTNEVFLPENSASLFNGARQLESIEGVGNFNTSKVTNMDEMFAHTLALKELDISQWDVSNVTSMSHTFAWMTNLRKLDVSQWDVSNVTTLTHAFAWTSNLVDIDVSQWNVGKVSSMSNLFMSSSSLAELDLSNWDTRNKNISGMFYLASRLSSLKLGEESVIGNTSLRNIVPTAEYTGRWVLEESLDSSVRTIAFENSNEFMANYDGNHPGTYVWERSRPEELVAALEPLSDQSTAITGWMTEVTDNRTITYQNTAGQTVTVTKESPRIKWGDYQDADQRIRQFEIPLAENERLATDTEVTLTVSKPSVETTGDLTIDKKVIKGLDYTANHFTLERKKLEALTSQAELHELILKESQATAHDVLTQDDRSQEIKIVATDLTKDEVDDGTYFATFQVGNKAYQFTIGIDVNSKIHHLKVSIPTKMVFESLYQGEETNREFVSPDYEIRNHSDLSVDTYVNQFIIEDDAGVTLLREDENPLDHAPLQEGQPKNFSDIKQPLLELQLMSNETKISLYGRRSEQRLAQVAPYSSVPFHLTGRFYGPYPKWISESDNEQGGYYQDSFVPTYRMILRFVPR

SEQ ID NO: 608 - protein, 878 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDA

SEQ ID NO: 609 - protein, 841 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLY

SEQ ID NO: 610 - protein, 840 aa, Enterococcus Sp.
FQSSPIAGGNPRADQTILAQGETTTIHANVSNGYRFVQWELVSGNTTIANRTSQSPSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPYPKWIAESDNEQGGYYQDSFVPTYRMILRFVPR

SEQ ID NO: 611 - protein, 816 aa, Enterococcus Sp.
TIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPYPKWIAESDNEQGGYYQDSFVPTYRMILRFVPR

SEQ ID NO: 612 - protein, 797 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFASLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDA

SEQ ID NO: 613 - protein, 786 aa, Enterococcus Sp.
MKSKKNSKKIIILMTVLVILLTHLPFHFAYGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDILTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKI

SEQ ID NO: 614 - protein, 1004 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 615 - protein, 1004 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGTVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETKERPNYVQISDRRVANERNGWQLSVTQNGQFRNESGHELIGSEIQLFNQELVTAQGGTKPELQEEPVQRIVPNTRKVLIQANGESGTGTWIYRFGDQQTADKSVGLYVPGGTNPEATSYSTKLTWELSAVPGN

SEQ ID NO: 616 - protein, 1004 aa, Enterococcus Sp.
MKIKKVLIVASVSLLCFPSLFFSVISTSMPVSAIENSVELSRESELMDPLTSTTETKAPIFSFEENQEPSIANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSAKSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETKERPNYVQISDRRVANERNGWQLSVTQNGQFRNESGHELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 617 - protein, 967 aa, Enterococcus Sp.
MELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNESGHELIGSEIQLFNQELVTAQGGTKPELQEEPVQRIVPNTRKVLIQANGESGTGTWIYRFGDQQTADKSVGLYVPGGTNPEATSYSTKLTWELSAVPGN

SEQ ID NO: 618 - protein, 954 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETKERPNYVQISELQEEPVQQILPNTRKVLIKANGESGTGTWIYRFGDQQTANKSVGLYVPGGTNPEATSYSTKLTWELSAVPGN

SEQ ID NO: 619 - protein, 945 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETKERPNYMQISDRRVANERNGWQLSVTQNGQFRNKSGNELIGSEIQLFNQELVSAQGGTKPELQEEPVQQILPNT

SEQ ID NO: 620 - protein, 871 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNET

SEQ ID NO: 621 - protein, 861 aa, Enterococcus Sp.
MKIKKVLVVASTSLLCFPSLFFSVITTSVPVFAIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRL

SEQ ID NO: 622 - protein, 1004 aa, Enterococcus Sp.
MKIKKALVVASTSLLCFPLLFFPVISTHIPVSAIENSAELPKAPVLLDPLGSTTETKVPIFSFEESQEPHMAGRQFELVVHASQEASEFVVDLPEGVSIVEDKRSTDIKFTNIEGNQWQVQASSPQMTFSLPLIVEKEGEYEVAIGESKTTLNIQAEESRQTSEQEIISSEEKETANTEESKVEEEMSVSNDEPSSTTETTENHSEQVMENARSTKETGVQDVANWQEFIRAFSDPTISTIEISNDFEVPITPLDNQTSLLTGNNSNVSGAATFVYLIKSSISRTLTINGNGHQIDFGSVSLGMYPATHNSNSPWNITFNDLDVYSGNWWGFFQTTNLTIAQHSVSNITLNNINSYGNELIAPYYTNVNISGVVNNHITETYTSKFRTNWRVNTVNSVNLETRSLRIKENAELNLSSVNSGNLIIGLGGLNANLTLEKNARINLESNGTSAGDNANGFGSSIDIVNGNLTMNEGSKINVVTTRNFSALNLRSANSVVKIDNGSKININSTSHTWESNAAHRNLVYMAGGSSLSIGEESEFNIEAKGRGAAASNIIHIAGNAKFSVGKNGTLNVKSDSTSISQSLLSFTSAGSTFQFSDAKRVNLERTGAITGTSTSNGLINIAGRTGLLDINVQSVKQWERGNFNATADFSWIPIFNLSIRYTGIVPRIDTVSSISQETTDSFKQLFTTQNVQRILFEKIPDVEVTMDPLTEGPNEINSYTITGKANPNSVIRFSGDSAIPSATIDSPDTSESEKYHTMADENGYYRYELPKDHRFTAGSTVTAYAFLNGKNDTASTIVEEKVVMSPVDPLDPKTDVKPENKPEISENQGRLSLDFVSQFNFGIQRISNSDQTYYAQPQRLLNDAGSVNESEERPNYVQISDRRPDNERNGWQLSVTQNGPFSNQSGHELIGSEIQLFNQELVSAQGGTAPKLHGEPVQRILPNTRKVLLQAEEESGTGTWIYRLGDSNTANKSVCLYIPEGANPEATSYSTKLTWELSAVPDN

SEQ ID NO: 623 - protein, 804 aa, Enterococcus Sp.
SQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 624 - protein, 782 aa, Enterococcus Sp.
MTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWVFFQTTNLTVVQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEVIPDHSWTPIFNLNLRYTGVVPRIETVSSIAQETADSFKQYFTTQNVQRILFEKIPDVEVTIDPLTEDPKEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 625 - protein, 1000 aa, Enterococcus Sp.
MKIKKVLIVASVSLLCFPSLFFSVISTSMPVSAIENSVELSRESELMDPLTSTTETKAPIFSFEENQEPSIANKQFQLVVRSSQDVSEFVLNLPEGVSIVEDKQSADSKFTNIEGSQWQVRTNSPQMIFSIPLVVEKAGAYEIAVGESKMTLNIQSEESQQPSEQEVTSSEEKETAKTEESTVEEEASVSSDEKSSTIDNSQNDPEQVTESARSTKEASVQDVANWEEFIRAFVDPSITTINVVSDFQTPDNPRLNLTDITTGGTSNPNGGTAFVYLNVANISRNLTVEGNGHQIDFRAITLCFNNITANSSTPWNITLKDLEIYHGNYYGPLTFNDLNVTNQTASQITYHNITNYGNQLIHSPYSSIKFSGKSSSKQVSAYTSAFGTWRINALDQTNIYASNLTILEDAEVELETISAGNLDLGGVVHPNNNFRMEKNSSLNAVSKGNAGEADGTSLLVRRGSVEIDEGAKLNLVPQNLRSAISLRTANSSLRIKEKGVLTIDSQGTKANANGALYNIIWMAAGSNLLVESGSTLNIVATEMAASPSNILHVNGNATVSIGKDATLNIKSDSTSNAQNLMYFASTGSTFEFSDAQEVNLERTGTIAGTSTANGLINIAGNTGLLDIDVQSVKQWARGNFEVIPDHSWTPIFNLNLRYTGVVPRIETVSSIAQETADSFKQYFTTQNVQRILFEKIPDVEVTIDPLTEDPKEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 626 - protein, 1000 aa, Enterococcus Sp.
MKIKKVLIVASVSLLCFPSLFFSVISTSMPVSAIENSVELSRESELMDPLTSTTETKAPIFSFEENQEPSIANKQFQLVVRSSQDVSEFVLNLPEGVSIVEDKQSADSKFTNIEGSQWQVRTNSPQMIFSIPLVVEKAGAYEIAVGESKMTLNIQSEESQQPSEQEVTSSEEKETAKTEESTVEEEASVSSDEKSSTIDNSQNDPEQVTESARSTKEASVQDVANWEEFIRAFVDPSITTINVVSDFQTPDNPRLNLTDITTGGTSNPNGGTAFVYLNVANISRNLTVEGNGHQIDFRAITLCFNNITANSSTPWNITLKDLEIYHGNYYGPLTFNDLNVTNQTASQITYHNITNYGNQLIHSPYSSIKFSGKSSSKQVSAYTSAFGTWRINALDQTNIYASNLTILEDAEVELETISAGNLDLGGVVHPNNNFRMEKNSSLNAVSKGNAGEADGTSLLVRRGSVEIDEGAKLNLVPQNLRSAISLRTANSSLRIKEKGVLTIDSQGTKANANGALYNIIWMAAGSNLLVESGSTLNIVATEMAASPSNILHVNGNATVSIGKDATLNIKSDSTSNAQNLMYFASTGSTFEFSDAQEVNLERTGTIAGTSTANGLINIAGNTGLLDIDVQSVKQWARGNFEVIPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTIVEEKIVVAPVDPLDPETEVEPENKPEIPEDQGRLSLDFVSQFNFETQKISVSDQTYYAQPQRLLNEDGTVNETKERPNYVQISDRRAANERNGWQLSVTQNGQFRNKSGNELIGSEIQLFNQELVTAQGGTKPELQEEPVQRIVPNTRKVLIKANGESGTGTWIYRFGDQQTANKSVGLYVPGGTNPEATSYSTKLTWELSAVPEN

SEQ ID NO: 627 - protein, 1000 aa, Enterococcus Sp.
MKIKKVLVVASVSLLCFPSLFFSVISTSMPVFAIENSVELSRESELMDPLTNTTETKAPIFSFEENQEPSIANKQFQLVVRSSQDVSEFVLNLPEGVSIAEDKSADSKFTNIEGGQWQVRTNSPQMIFSIPLVVEKAGAYEIAVGESKMTLNIQSEESQQPSEQEVTSSEEKETAKTEESTVEEEASVSSDEKSSTTDTSQNDPEQVTESARSTKEASVQDVANWEEFIRAFVDPSITTINVVSDFQTPDNPRLNLTDITTGGTNNPNGGTAFVYLNVANISRNLTVEGNGHQIDFRAITLCFNNITANSSTPWNIALKDLEIYHGNYYGPLTFNDLNVTNQTASQITYHNITNYGNQLIHSPYSSIKISGKSSSKQVSEYTSSFGTWRINALDQTNIYASNLTIVEDAEVELETISAGNLDLGGVVHPNNNFRMEKNSSLNAVSKGNAGEADGTSLLVRRGSVEIDEGAKLNLVPQNLRSAISLRTANSSLRIKEKGVLTIDSQGTKANANGALYNIIWMAAGSNLLVESGSTLNIVATEMAASPSNLLHVNGDATVSIGKDATLNIKSDSTSNDQNLMYFASAGSTFEFSDAQEVNLERTGTIAGTSTANGLINIAGSTGLLDIDVQSVKQWARGNFEEIPDHSWTPIFNLNLRYTGIVPRINDDVSSIPQETADSFKQYFTTQNVQRVLFEKIPDVEVTIDPLTEDPNEVNSHTITGKANPNSMIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETKERPNYVQISDRRAANERNGWQLSVTQNGQFRNESGHELIGSEIQLFNQELVTAQGGTKPELQEEPVQRIVPNTRKVLIQANGESGTGTWIYRFGDQQTADKSVSLYVPGGTNPEATSYSTKLTWELSAVPGN

SEQ ID NO: 628 - protein, 711 aa, Enterococcus Sp.
QIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPKEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 629 - protein, 923 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASAPRNKRSIPPKTSAIYQALFQEKWDQFCSSSSIAAVDSPIAYLRALYLFALQLEENTKDTRALKLSQRRPELKDLVLNQHSVSGQVPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVAEAGAKAFYHNYYNWKTDLIGPAKLTDFLSHTQLDADQLQALLALQTQSPRQSPNCKQETSLTYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSATFDDTTRQQLCAGLGLQDTQDSLQLLINPNKPATRTIETVSEIYRQARIARLFGVSVVECRQLVQMLGNANLLMQLRHPTLRNKPKGMTDFLDVLMQLEWASRWFKENGSSLALLRCQLLLDRQVQDPVINQLLKEFALYDQASLSKALQPLDLPQQPLDEKDRLPAVDWEVLACTALQQMRPSNNIETALDHVLSSVQISTAPARTTQLINQAKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPAHMLIKASELKADSAFADWKSVGEAITSAYP

SEQ ID NO: 630 - protein, 923 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASAPRNKRSIPPKTSAIYQALFQEKWDQFCSSSSIAAVDSPIAYLRALYLFALQLEENTKDTRALKLSQRRPELKDLVLNQHSVSGQVPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVAEAGAKAFYHNYYNWKTDLIGPAKLTDFLSHTQLDADQLQALLALQTQSPRQSPNCKQETSLTYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSATFDDTTRQQLCAGLGLQDTQDSLQLLINPNKPATRTIETVSEIYRQARIARLFGVSVVECRQLVQMLGNANLLMQLRHPTLRNKPKGMTDFLDVLMHLEWASRWFKENGSSLALLRCQLLLDRQVHDPVINQLLKEFTHYDQASLSKALQPLDLPQQPIDEKDRLPAVDWEVLAYTALQQMRPSNNIETALDHVLSSVQISTAPARTTQLINQAKSKLNTLLSTVRDELWSLYLRLKAIIQAVPQAPSDANGYQKYDNDQHFLRLYAPAAAPLQTLSYLILLLPHAADILQLPLSSQALHQFLVNPHWLTRKYKAPSLLELTPYNLYLMQQFKHCIHHCGLTEEQLLNYFEHANALPNSAAKNTSEDTNEHLAQLLGWSASEIDVFSNQLKPPRITSMNRLDWVLRCRQASIDTGLPANMLIKASELKADSAFADWKSVGEAITSAYP

SEQ ID NO: 631 - protein, 855 aa, Pseudomonas Sp.
QNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQAPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVTETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVECRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYTALQQMRPSNNIETALDHVLSSVQISTAPARTTQLINQAKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPANMLIKASELKADSAFADWKSVGEAITSAYP

SEQ ID NO: 632 - protein, 931 aa, Pseudomonas Sp.
MNMQTDSSPLLAKLIDHSRPPAPGRDDFKTALRRLNLNSVLDIVRLSERAFAEQLATYNDDDAHTVYLKAQSAAAQLETLFREQQVSSPPSSPRNKRSLPPETSATYQALFKEKWDQFCSSSSIAALDSPTAYLRALYLFALQLEENTKDTNALKLSQRRPELKDQVINQHSVSSQVPMLSIVNQILLKNIAPAKEEDTYRVLSETWYPFSLPYHLHHQQCQQGLSGDKPALGELNYRISRQLPLAGETSTYGQVGEQNNEVQCQLSGLSPNQQTMLKAKWVTETEVEKEEKVKKFHLQFYNWTIDQTGPEKLTDFLNHTQLDADQLQALLAQQTQSPRQSPNCKQNPGLAYGACYINGTTTPAISLDNAKLTHVSLERFDRLQRMIRLQRWLGLPFAQLDTLIVSAMRCEGHRNSTLQITHNTLRALGVFCYLSKRYTLQAEEFAALLHQLPVHASGDRMSLFDQVFNRTGSALPPLYLDSATFDDTTRQQLCAGLGLQDTQDSLQLLIPPDQPATRTIETISKIYRQARIARLFGLSVVECRQLVQMLGNANFLMQLRNPTLRNKPKGTTDFLDMLMHLEWASRWFKENGSSLTLLRRQLLLDSQVQDPIINQLLKEFASYDQASLSKALQLLDLPQQPGDEKDRLPAVDWESLAYAALQRMRPNNSIEMALDQVLSSVQISTMPARTTTLIDRAKPKFNTLLSNARDELWTLYLRLKEITQAVLHAPNNANGYQKYDNDYHFLRLYAPAATPLQTLSYLILRLPHAADILQLPLSPQALHQFLVNPHWLASKYRASSLLELTPYNLYLMQQFKHCIHHCGLTEEQLLNYFEHANTLPNGATQNTSEETNERLAQLLGWSASEIDVFSSQLKPPRITSMNRLDWVLRCRQASIDTGLPANMLIKASELKADSALADWKSVGEAVTSAYP

SEQ ID NO: 633 - protein, 931 aa, Pseudomonas Sp.
MNMQTDSSPLLAKLIDHSRPPAPGRDDFKTALRRLNLNSVLDIVRLSESAFAEQLATYNDDDAHTVYLKAQSAAAQLETLFREQQVSSPPSSPRNKRSLPPETSATYQALFKEKWDQFCSSSSIAAVDSPTAYLRALYLFAQQLEGNTQDANALKLSQRRPELKDQVINQHSVSSQVPMLSIVNQILLKNIAPAKEEDTYKVLSETWYPFSLPYHLHHQQCQQGLSGDKPALGEVNYRISRQLPLAGETSTYGQVGEQNNEVQCQLSGLSPQQQTMLKAKWVTETEVEKEEKVKKFHLQFYNWTIDQTGPEKLTDFLNHTQLDADQLQALLAQQTQSPRQSPNCKQNPGLTYGACYINGTTTPAISLDNAKLTHVSLERFDRLQRMIRLQRWLGLPFAQLDTLIVSAMRCEGHRNSTLLITHNTLRSLGVFCYLSKRYTLQAEEFAALLHQLPVHASGDRVSLFDQVFNRTGSALPPLYLDSATFDGTTRQQLCAGLGLQDTQDSLQLLINPNKPATRTIETVSEIYRQARVARLFGLSVVECRQLVQMLGNANFLMQLRNPTLRNKPKGTTDFLDMLMHLEWASRWFKENGSSLALLRRQLLLDRQVQDPIINQLLKEFASYDQASLSEALHRFDLPQQPDDETVRLPAVDWESLAYAALQRMRPNNSIEMALDQVLSSVEISTMPVRTTHLINQAKPTLNTLLSKVRDELWALYLRLKEITQTVLHEPSNTNGYQKYDNDHHFLRLYAPAASPLQTLSYLILRLPHAADILQLPLSPQALHQFLVNPHWLASKYKMSSLLELTPYNLYLMQQFKHCLHHCGLTEEQLLDYFEHANTLPNGATQNTSEETNERLAQLLGWNASEIDVFCDKLRPPRITSMMRLDWVLRCRQASIDTGLPANMLIKASELKADSTFADWKSVGEAITSAYS

SEQ ID NO: 634 - protein, 676 aa, Pseudomonas Sp.
MQTDNSPLLAQLIDHSRPPAPGRDDFKTALRRLNIHSILDIVRLSEEAFTEQLKKYNDDDAHTVYLKAQNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQAPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVTETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVECRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYSALQQMRPRSNIDTYIYYVLPSRHYS

SEQ ID NO: 635 - protein, 237 aa, unknown
  environmental sample
MVKKWERALVSFHVRKPFHRFEVETVGTGFLFENEGVVGIYTASHVIKQIMDDKTRTVRINDSFYLLSNVNVFYEDTQDYAIVELPKDAMNGQRIVAFPLAQRKDLNLTKSFMIFGYPANKNVLRLGKQHLFNTLNIFRNDFKYDTETEDIFFEFNKKDKYIYEPDSSFKSLPALNGMSGSPIVQIMVNKNTEALTLRVIGIFKIHRHNNKEKYLIGSTFTNFADEINMMISLGVLT

SEQ ID NO: 636 - protein, 439 aa, Bacillus Sp.
MKSKIMAGFLITSIVTGATIPINTLATPIVQAETKQDNIDISSALRKIGAHSKLTQTFIDGALASPNVQLEEVPSLNTTQFLIKQDMKEWSSELYPKLILLNSKSKGFVTKFNSYYPTLKGFIDNGEDKEGFTDRLEVLQDMTITNQESVQRQINELTDLKLQVDKKLKNLDTDVAKTQSVLNSEGTGKIDKLKNEMLDTKKSIQNDLQQIALLPGALNEQGLKVFQEIYSLSKDIIEPAAQTAVVAYNKGKEINNAIVDAENKAEQEAKEKGKSAIEIEAAKKEAREAIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDVEIELMKRYKEDLDLINNSITKLSTEVDTNNTQSQKDTLRRLKSVTTQLEEQVYKF

SEQ ID NO: 637 - protein, 439 aa, Bacillus Sp.
MKNKIMTGFLITSIVTGATIPINTLATPIVQAETKQENIDISSALRKIGAHSKLTQTFIDGALSSPNVQLEEVPSLNTTQFLIKQDMKEWSSELYPKLILLNSKSKGFVTKFNSYYPTLKGFVDNKEDKEGFTDRLEVLQDMTITNQESVQRQINELTDLKLQVDKKLKNLDTDVAKTQSVLNSEGTGKIDKLKNEMLDTKKSIQNDLQQIALLPGALNEQGLKVFQEIYSLSKDIIEPAAQTAVVAYNKGKEINNAIVDAENKAEQEAKEKGKSAIEIEAAKKEAREAIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDGEIELMKRYKEDLDLINNSITKLSTEVDTNNTQSQKDTLRRLKSVTTQLEEQVYKF

SEQ ID NO: 638 - protein, 439 aa, Bacillus Sp.
MKNKIMTGFLITSIVTGATFPINTLATPIVQAETKQDNVDISSALRKIGAHSKLTQTFIDGALASPNVQFEEIPSLNTTQFLIKQDMKEWSSELYPKLILLNSKSKGFITKFNSYYPTLKGFVDNKEDKEGFTDRLEVLQDMTITNQESVQRQINELTDLKLLVDKKLKNLDTDVVKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFTNQVDGEIELMKRYKEDLDLINNSITKLSTEVDTNNTQAQKDILRRLKSVTIQLEEQVYKF

SEQ ID NO: 639 - protein, 439 aa, Bacillus Sp.
MKNKIMAGFLITSMVSGATIPINTLAMPIVRAEMKQDNIDISSALRKIGAHSKLTQTFIDGALASPNVQLEEVPSLNTNQFLIKQDMKEWSSELYPKFILLNSKSKGFVTKFNSYYPTLKGFVDNKEDKDGFTDRLEVLQDMTITNQESVQRQINELIDLKLQVNKKLKNLDSDVIKAQSILSSEGTGKIDKLKTEMLDTKKSIQNDLQQIALLPGALNEQGLKVFQEIYSLSKDIIEPAAQTAVVAYNKGKEINNAIVDAEKKAEQEAKEKGKSAIEIEAAKKEAREAIERSKKGEIAAAAVTKTKEYDLMKVIDPEKIKKTYNTFAEINKLTAEQRAYLNDLEKQNQKLYDLTTKLTVVDLQKSMILFMQNDLHTFANQVDGEIELMKRYKEDLDLINNSITKLSTEVDANNTQSQKDTLRRLKSVTTQLEEQVYKF

SEQ ID NO: 640 - protein, 439 aa, Bacillus Sp.
MKNKIMTGFLITSIVTGATIPMNTLATPTVQAETKQENIDISSALRKIGAHSKLTQTFIDGALANPNVQLEEVPSLNTTQFLIKQDMKEWSSELYPKLILLNSKSKGFATKFNSYYPTLKGFVDNKEDKEGFLDRLEVLQDMTITNQENVQRQINELTDLKLQVDKKLKNLDTDVVKAQSVLSLEGTGKIDKLKNEMLNTKKSIQNDLQQIALLPGALNEQGLKVFQEIYSLSKDIIEPAAQTAVVAYNKGKEINNAIVEAEKKAEQEATEKGKSAIEIEAAKKEAREAIEKSKKGEIAAAAVTKTKEYDLMKVIDPEKIKKTYSTFAEINKLTAEQRAYLNDLEKQNQKLYELTTKLTVADLQKSMILFMQNDLHTFANQVDGEIELMKRYKEDLNLISNSITKLSTEVDTNNTQSQKDTLRRLKNVTNQLEEQVYKF

SEQ ID NO: 641 - protein, 446 aa, Bacillus Sp.
MKNKIMTGFLITSIVTGATFPINTLATPIVQAETKQDNVDISSALRKIGAHSKLTQTFIDGALASPNVQFEEVPSLNTTQFLIKQDMKEWSSELYPKLILLNSKSKGFVTKFNSYYPTLKGFVDNKEDKEGFTDRLEVLQDMTITNQESVQRQINELTDLKLLVDKKLKNLDTDVVKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFTNQVDGEIELMKRYKEDLDLINNSITKLSTEVDTNNTQSQKDTLRRLRLFLSILSQRQSFRQKQNKKI

SEQ ID NO: 642 - protein, 439 aa, Bacillus Sp.
MKNKIMTGFLITSIVTGATIPINTLAMPIVQAETEQDSIDISSSLRKIGAHSKLTQTFIDGALASPNVQLEEVPSLNTTQFLIKQDMKEWSSELYPKLILLNSKSKGFATKFNSYYPTLKGFVDNKEDKEGFIDRLEVLQDMTITNQENVQRQINELTDLKLQVDKKLKNLDTDVVKAQSILSSEGTGKIDKLKNEMLNTKKSIQNDLQQIALLPGALNEQGLKVFQEIYSLSKDIIEPAAQTAVAAYNKGKEINNAIVEAEKKAEQEATEKGKSALEIEVAKKEAREAIENNKKGEIAAAAVTKTKEYDLMKVIDPEKIKKTYSTFAEINKLTAEQRAYLDDLEKQNQKLYDLTTKLTVADLQKSMILFMQNDLHTFANQVDGEIDLMKRYKDDLNLINNSITKLSTEVDTVNNQSQKDTLRRLKNVTSQLEEQVNKF

SEQ ID NO: 643 - protein, 413 aa, Bacillus Sp.
MKNKIMTGFLITSIVTGATFPINTLATPIVQAETKQDNVDISSALRKIGAHSKLTQTFIDGALASPNVQFEEIPSLNTTQFLIKQDMKEWSSELYPKLILLNSKSKGFITKFNSYYPTLKGFVDNKEDKEGFTDRLEVLQDMTITNQESVQRQINELTDLKLLVDKKLKNLDTDVVKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFTNQVDGEIELMKRYKEDLDLINNSITKLSTEVDTN

SEQ ID NO: 644 - protein, 474 aa, Bacillus Sp.
MEKILFSSVYEEILTLDFTAYTIKIVKNNSKEVYGMKGKIMAGFLITSIVTGATIPINTLATPIVQAETKQDNIDISSALRKLGAHSKLTQTFIDGALANPNVQLEEVPSLNTTQFLIKQDMKEWSSELYPKLILLNSKSKGFVTKFNSYYPTLKGFVDNKEDKEGFTDRLEVLQDMTITNQESVQRQINELTDLKLQVDKKLKNLDTDVAKTQSVLNSEGTGKIDKLKNEMLDTKKSIQNDLQQIALLPGALNEQGLKVFQEIYSLSKDIIEPAAQTAVVAYNKGKEINNAIVDAENKAEQEAKEKGKSAIEIEAAKKEAREAIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDGEIELMKRYKEDLDLINNSITKLSTEVDTNNTQSQKDTLRRLKSVTTQLEEQVYKF

SEQ ID NO: 645 - protein, 466 aa, Bacillus Sp.
MCEEILTLCCTTFTIKTVKNNSEEVYGMKNKIMTGFLITSIVTGATIPINTLATPTVQAETKQENIDISSALRKIGAHSKLTQTVIDGALANPNVQLEEVPSLNTTQFLIKQDMKEWSSELYPKLILLNSKSKGFATKFNSYYPTLKGFVDNKEDKEGFLDRLEVLQDMTITNQENVQRQINELTDLKLQVDKKLKNLDTDVVKAQSVLSSEGTGKIDKLKNEMLNTKKSIQNDLQQIALLPGALNEQGLKVFQEIYSLSKDIIEPAAQTAVVAYNKGKEINNAIVEAEKKAEQEATEKGKSAIEIEAAKKEAREAIEKSKKGEIAAAAVTKTKEYDLMKVIDPEKIKKTYSTFAEINKLTAEQRAYLNDLEKQNQKLYELTTKLTVADLQKSMILFMQNDLHTFANQVDGEIELMKRYKEDLNLISNSITKLSTEVDTNNTQSQKDTLRRLKNVTNQLEEQVYKF

SEQ ID NO: 646 - protein, 466 aa, Bacillus Sp.
MCEEILTLCCTTFTIKTVKNNSEEVYGMKNKIMTGFLITSIVTGATIPMNTLATPTVQAETKQENIDISSALRKIGAHSKLTQTFIDGALANPNVQLEEVPSLNTTQFLIKQDMKEWSSELYPKLILLNSKSKGFATKFNSYYPTLKGFVDNKEDKEGFLDRLEVLQDMTITNQENVQRQINELTDLKLQVDKKLKNLDTDVVKAQSVLSLEGTGKIDKLKNEMLNTKKSIQNDLQQIALLPGALNEQGLKVFQEIYSLSKDIIEPAAQTAVVAYNKGKEINNAIVEAEKKAEQEATEKGKSVIEIEAAKKEAREAIEKSKKGEIAAAAVTKTKEYDLMKVIDPEKIKKTYSTFAEINKLTAEQKAYLNDLEKQNQTLYDLTTKLTVADLQKSMILFMQNDLHTFANQVDGEIELMKRYKEDLNLINNSITKLTTEVDTNNTQSQKDTLRRLKNVTIQLEGQVNKF

SEQ ID NO: 647 - protein, 474 aa, Bacillus Sp.
MEKSLSSSICEEILTLGCTTFTIKTVKDNSEEVYGMKNKIMTGFLITSIVTGATIPINTLATPIVQAEMKQENIDISSALRKIGAHSKLTQTFIDGALASPNVQLEEVPSLNTTQFLIKQDMKEWSSELYPKLILLNSKSKGFATKFNSYYPTLKGFVDNKEDKEGFIDRLEVLQDMTITNQENVQRQINELTDLKLQVDKKLKNLDTDVVKAQSVLSSEGTGKIDKLKNEMLNTKKSIQNDLEQIALLPGALNEQGLKVFQEIYSLSKDIIEPAAQTAVVAYNKGKEINNTIVEAEKKAEQEATEKGKSAIEIEAAKKEAREAIEKSKKGEIAAAAVTKTKEYDLMKVIDPEKIKKTYSTFAEINKLTAEQRVYLNDLEKQNQKLYDLTTKLTVADLQKSMILFMQNDLHTFANQVDGEIELMKRYKEDLNLINNSITKLVTEVDTSNTQSQKDTLRRLKNVTNQLEEQVYKF

SEQ ID NO: 648 - protein, 439 aa, Bacillus Sp.
MKNKIITGFLITSIVTGANIPINTLAMPIVQAETQQENTDISSSLRKLGAQSKLIQTYIDQALMSPNVQLEEVPALNTNQSLIKQDMNEWSSELYPKLILLNSKSKGFVTQFNSYYPTLKQFVDNNEDKEGFLDRLEVLQDKTTTNQESVQRQINELTDIKLQIDKKLKDLDTDVTKAQGVLSSEGTGKIDQLKNELLNTQKSIQSDLQQIALLPGALNEQGLKIFQEIYSLSKDIIEPAAQTAVAAYNKGKEINNSILEAEKKAEQEAKEKGKSALEIEAAKKEAREAIEKSKQAEIAAAAITKTKEYDLTKVIDPEKIKKTYSAFAEVNKLTTEQRAHLDDLEKQNQKLYDLTKSLTVADLQKSMLLIMQNDLHTFANQVDVELDLLKRYKEDMDLIKNNITKLSTNVDTTDQQSQKDTLRQLKNVTSYLEEQVNKF

SEQ ID NO: 649 - protein, 439 aa, Bacillus Sp.
MKNKIIKGFLITSIVTGAAIPINTLATPIVKAETQQENTDISSSLRKLGAQSKLIQTYIDQALMSPNVQLEEVPSLNTNQSLIKKDMTEWSSELYPKLILLNSKSKGFVTQFNSYYPTLKQFVDNKEDKEGFLDRLEVLQDKAMTNQENVQRQINELTDLKLQLDNKLKDLDTDVTKAQGALSSEGTGKIDQLKNELQDTQKSIQNDLQQIALLPGALNEQGLTIFKEVYNLSKDIIEPAAQTAVAAYNKGKEINKSILEAEKKAEQEAKEKGKSALEIEAAKKEAREAIEKSKQAEIAAAAVTKTKEYDLTKVIDPEKIKKTYSAFAEVNKLTAEQRAHLADLETQNQKFYDLTKNLTVADLQKSMLLIMQNDLHTFANQVDVELDLLKRYKEDLGLIKNSITKLSTNVDTTDQQSQKDTLRQLKNVTSYLEEQVYKF

SEQ ID NO: 650 - protein, 439 aa, Bacillus Sp.
MKNKILTGFLITSIVSGANIPINTLATPIVQAETQQENMDISSSLRKLGAQSKLIQTYIDKALMSPNVQLEEVPSLNTNQSLIKQDMNEWSSELYPKLILLNSKSKGFVNQFNSYYPTLKQFVDNKEDKEGFLDRLEVLQDKATINQESVQRQINELTDLKLQIDKKLKDLDTDVTKAQGVLNSEGTGKIDQLKNELLNTQKSIQSDLQQIALLPGALNEQGFKIFQEIYSLSKDIIEPAAQTAVAAYNKGKEINSSILEAEKKAEKEAKEKGKSALEIEAAKNEAREAIEKSKQAEIAAAAITKTKEYDLTKVIDPEKIKKTYSAFAEVNKLTTEQRAHLDDLEKQNQKFYDLTKNLTVADLQKSMILIMQNDLHTFANQVDVELDLLKRYKEDMNLIKNNITKLSTNVDTTDRQSQKDTLRQLNNATIYLEEQVNKF

SEQ ID NO: 651 - protein, 439 aa, Bacillus Sp.
MKNKIITGLFITSIVTGATIPINTLATPIVHAETQQESMDISSSLRKLGAQSKLIQTYIDQGLMSPNVQLAEVPALNTNQSLIKQDMKEWSSELYPNLILVNSKSKGFVTKFNSYYPTLKAFVDNKEDKEGFVDRLEVLQDMTMTNQENVQRQINELTDLKLQLDKKLQDLDMDVTKAQGVLSSDGTGKIDQLKNELQNTQKSIQNDLQQIALLPGALNEQGFVIFKEVYNLSKDIIEPAAQTAVAAYNKGKEINNSILEAEKKAEQEAKEKGKSALEIEAAKKEAREAIEKSKQAEIAAAAVTKTKEYDLTKVIDPEKIKKTYSAFAEVNKLTAEQRTHLADLETQNQKFYDLTKNLKIADLQKSMLLIMQNDLHTFANQVDVELDLLKRYKEDLGVIKNSITKLSTNVDITNQQSQKDTLRQLKNVISYLEEQVYKF

SEQ ID NO: 652 - protein, 439 aa, Bacillus Sp.
MKTKIMTGFLITSIVTGATIPINTLATPIVQAETQQENMDISSSLRKLGAHSKLVQTYIDQSLMSPNVQLEEVPALNTNQFLIKQDMKEWSSELYPQLILLNSKSKGFVTKFNSYYPTLKSFVDNKEDREGFSDRLEVLQEMAMTNQENAQRQINELTDLKLQLDKKLKDFDTNVATAQGILSTDGTGKIDQLKNEILNTKKAIQNDLQQIALIPGALNEQGFAIFKEVYSLSKEIIEPAAQAGVAAYNKGKEINNSILEAEKKAAQEATEQGKTALEIEAAKKAAREAIEKSKQGEIAAAAAAKTQEYDLMKVIDTEKIKKTFGVFAEVNKLTAEQRAYLDDLEKQNQKIYDLTTKLSIADLQKSMLLLTQNDLHTFANQVDVELDLLKRYKEDLNLIKNSITKLSTNVDTTNEQSQKDTLRQLKNVISYLEEQVYKF

SEQ ID NO: 653 - protein, 434 aa, Bacillus Sp.
MTGFLITSIVTGATIPINTLATPIVQAETQQENMDISSSLRKLGAHSKLVQTYIDQSLMSPNVQLEEVPALNTNQFLIKQDMKEWSSELYPQLILLNSKSKGFVTKFNSYYPTLKSFVDNKEDREGFSDRLEVLQEMAMTNQENAQRQINELTDLKLQLDKKLKDFDTNVATAQGILSTDGTGKIDQLKNEILNTKKAIQNDLQQIALIPGALNEQGFAIFKEVYSLSKEIIEPAAQAGVAAYNKGKEINNSILEAEKKAAQEATEQGKTALEIEAAKKAAREAIEKSKQGEIAAAAAAKTQEYDLMKVIDTEKIKKTFGVFAEVNKLTAEQRAYLDDLEKQNQKIYDLTTKLSIADLQKSMLLLTQNDLHTFANQVDVELDLLKRYKEDLNLIKNSITKLSTNVDTTNEQSQKDTLRQLKNVISYLEEQVYKF

SEQ ID NO: 654 - protein, 442 aa, Bacillus Sp.
MYGMKNKIMTGFLITSIVTGANIPINTLATPIVQAETQQENMDISSSLRKLGAQSKLIQTYIDRSLMSPNVQLEEVPALNTNQFLIKQDMKEWSSELYPQLILLNSKSKGFVTKFNSYYPTLKSYVDNKEDREGFLDRLEVLQEMAMTNQENAQRQINELTDLKLQLDKKLKDFDTDVATAQGILGTDGTGKIDQLKNEILNTKKAIQNDLQQIALIPGALNEQGFAIFKEIYSLSKEIIEPAAQAGMAAYNKGKEINNSILEAEKKAAQEATEQGKTALEIESAKKAAREAIEKSKQGEIAAAAAAKTQEYDLMKAIDTEKIKKTFGVFAEVNKLTAEQRSYLDDLEKQNQKIYDLTTKLSIADLQKSMLLLSQNDLHTFANQVDVELDLLKRYKEDLDLIKNNITKLSTNVDVTNEQSQKDTLRQLKNVISYLEEQVYKF

SEQ ID NO: 655 - protein, 442 aa, Bacillus Sp.
MYGMKTKIITGLLVTSIVTGGNIPINTLATPIVQAETQQEGMDISSSLRKLGAQSKLIQTYIDQSLMSPNVQLEEVTALNTNQFLIKQDMKEWSSELYPQLILLNSKSKGFVTKFNSYYPTLKSFVDNKEDREGFSDRLEVLQEMAMTNQENTQRQINELTDLKLQLDKKLKDFDTNVATAQGILSTDGTGKIDQLKNEILNTKKAIQNDLQQIALIPGALNEQGFAIFKEVYSLSKEIIEPAAQAGVAAYNKGKEINNSILEAEKKAVQEATEQGKTALEIESAKKAAREAIEKSKQGEIAAAAAAKTQEYDLMKVIDTEKIKKTFGVFAEVNKLTAEQRAYLDDLEKQNQKIYDLTTKLSIADLQKSMLLLTQNDLHTFANQIDVELDLLKRYKEDLNLIKNSITKLSTNVDTTSEQSQKDTLRQLKNVISYLEEQVYKF

SEQ ID NO: 656 - protein, 453 aa, Bacillus Sp.
MNQVIKNNGKGVYGMKNKIMTGFLITSIVTGATIPINTLATPIVQAETQQESMDISSSLRKLGAQSKLIQTYIDQSLMSPNVQLEEVPALNTNQFLIKQDMKEWSSELYPQLILLNSKSKGFVTKFNSYYPTLKSYVDNKEDREGFLDRLEVLQEMAMTNQENAQRQINELTDLKLQLDKKLKDFDTDVVTAQGIVGTDGTGKIDQLKNEILNTKKAIQNDLQQIALIPGALNEQGFAIFKEVYSLSKEIIEPAAQAGMAAYNKGKEINNSILEAEKKAAQEATEQGKTALEIESAKKAAREAIEKSKQGEIAAAAAAKTQEYDLMKAIDTEKIKKTFGVFAEVNKLTAEQRAYLDDLEKQNQKIYDLTTKLSIADLQKSMLILTQNDLHTFANQVDVELDLLKRYKEDLDLIKNSITKLSTNVDTTNEQSQKDTLRQLKNVISYLEEQVYKF

SEQ ID NO: 657 - protein, 460 aa, Bacillus Sp.
MLGRTSYMNQFIEKNGKGVYGMKNKIMTGFLITSIVTGATIPINTLATPIVQAETQQENMDISSSLRKLGAQSKLIQTYIDQSLMSPNVQLEEVPALNTNQFLIKQDMKEWSSELYPQLILLNSKSKGFVTKFNSYYPTLKSYVDNKEDREGFVDRLEVLQEMAMTNQENAQRQINELTDLKLQLDKKLKDFDTNVATAQGILGTDGTGKIDQLKNEILNTKKAIQNDLQQIALIPGALNEQGFAIFKEIYSLSKEIIEPAAQAGMAAYNKGKEINNSILEAEKKAAQEATEQGKTALEIESAKKAAREAIEKSKQGEIAAAAAAKTQEYDLMKAIDTEKIKKTFGVFAEVNKLTAEQRSYLDDLEKQNQKIYDLTTKLSIADLQKSMLLLSQNDLHTFANQVDVELDLLKRYKEDLDQIKNNITKLSTNVDATNEQSQKDTLRQLKNVISYLEEQVYKF

SEQ ID NO: 658 - protein, 468 aa, Bacillus Sp.
MRVQGESLALGRTSYMNRVIKNNGKGVYGMKNKIMTGFLITSIVTGATIPINTLATPIVQAETQQESMDISSSLRKLGAQSKLIQTYIDQSLMSPNVQLEEVPALNTNQFLIKQDMKEWSSELYPQLILLNSKSKGFVTKFNSYYPTLKSYVDNKEDSEGFLDRLEVLQEMAMTNQENAQRQINELTELKLQLDKKLKDFDTDVATAQGILSTDGTGKIDQLKNELLNTKKAIQNDLQQIALIPGALNEQGFAIFKEVYSLSKEIIEPAAQAGMAAYNKGKEINNSILEAEKKAAQEAKEQGKTALEIESAKKAAREAIERSKQGEIAAAAATKTQEYDLMRAIDTEKIKKTFGVFAEVNKLTAEQRAYLDDLEKQNQKIYDLTTKLSIADLQKSMLLLSQNDLHTFANQVDVELDLLKRYKEDLDLIKNNITKLSTNVDATNEQSQKDTLRQLKNVISYLEEQVYKF

SEQ ID NO: 659 - protein, 440 aa, Bacillus Sp.
MKNEITKGCIITSLIFGAAVSTNVFLTPVVLQAETQQERTDISPSLQQLGVHSKFIQTHIDQVLTTPNIELEEIPVLNTNQSLIKQDMKEWSSKISPNLFLLNSKSKGFVTKFNNYYSTLKGFVDNKKDKEGFVDRLEVLQEMTITNQENLQRQINELTEFKLQLDKKIENLDTNVKKGHEALVSDGTRKIDQIENELMNTKKLIRTNLQGIALLPGALNEQGLKVFQEVYHLSKDIIEPATQTAVAAYNKGKEIKNSIVEAVKKAAKEAKEKGKSELEIEAAKKEAREAIEKSKKGEMAAAAAAETKEYDLMKAVDPEKIKNTLSTFAKINKLTADQQAHLNDLAEQNQKLYDLTKKLTIADLQKSMILFMQNDLQTFADQVNLELDLMKRYKEDLNLIKNSITTLSTNVDTTNQASQKDTLRRLKNITSYLGEQVDKF

SEQ ID NO: 660 - protein, 409 aa, Bacillus Sp.
MMKFPFKVITLATLATVITATNGSTIHALAQEQTAQEQKIENYALGPDGLKKALAETGSHILVMDLYAKTMIKQPNVNLSNIDLGSGGGELIKNIHLNQELSRINANYWLDTAKPNIQKTARNIVNYDEQFQNYYDTLVDTVKKKDKVSLKEGIGDLIDTIHTNSNDVTEVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWNDIHKDAEFISKDIAFKQEKTN

SEQ ID NO: 661 - protein, 409 aa, Bacillus Sp.
MMKFPFKVITLATLATVITATNGSTIHALAQEQTAQEHKIENYALGPEGLKKALAATGSHILVMDLYAKTMIKQPNVNLSNIDLGSGGEELIKNIHLNQELSRINANYWLDTAKPNIQKTARNIVNYDEQFQNYYDTLVDTVKKKDKMSLKEGIGDLIDTIHTNSNEVTEVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWNDIHKDAEFISKDIAFKQEKTN

SEQ ID NO: 662 - protein, 408 aa, Bacillus Sp.
MKFPFKVITLATLATVITATNGSTIHALAQEQTAQEQKIENYALGPEGLKKVLAETGSHILVMDLYAKTMIKQPNVNLSNIDLGSGGGELIKNIHLNQELSRINANYWLDTAKPNIQKTARNIVNYDEQFQNYYDTLVDTVKKKDKAGLKEGIGDLIGTIHTNSNEVTEVIKMLEAFKTKLYTNTVDFKNNVGGPDGQGGLTAILAGKQALFPQLQAEIENLRSTQKAHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNTMGANYKDLYDNIDQMQEHKLSLIPDDLKAAKQSWNDIHKDAEFISKDIAFKQEKTN

SEQ ID NO: 663 - protein, 409 aa, Bacillus Sp.
MMKFPFKVITLATLATVMTATNGSTIHALAQEQTAQEQKVENYTLGPEGLKKALAETGSHILVMDLYAKTMIKQPNVNLSNIDLGSGGGELIKNIHLNQELSRINANYWLDTAKPNIQKTARNIVNYDEQFQNYYDTLVDTVKKKDKTSLKEGIGDLIGTIHTNSNEVTEVIKMLEAFKTKLYTNTVDFKNNVGGPDGQGGLTAILAGKQALAPQLQAEIENLRSTQKAHFDNVLAWSIGGGLGAAILVIGTIAGAVVIVVSGGTATPAVIGGLTALGAAGIGLGTAAGVEASNHMNSYNEISNKIGELSMKADLANQAVISLTNTKDTLTYLYQTVDQAIMSLTSIQQQWNAMGANYKDLYDNIDQMQEHKLSLIPDDLKAAKQSWDDIHKDAEFISKDIAFKQEKTN

SEQ ID NO: 664 - protein, 413 aa, Bacillus Sp.
MKFPFKVITLATLATVITATNSSTIHALAQEQTAQEQTAQEQKIENYALGPEGLKKVLAETGSHILVMDLYAKTMIKQPNVNLSNIDLGSGGGELIKNIHLNQELSRINANYWLDTAKPNIQKTARNIVNYDEQFQNYYDTLVDTVKKKDKAGLKEGIGDLIGTIHTNSNEVTEIIKMLEAFKTKLYTNTVDFKNNVGGPDGQGGLTAILAGKQALVPQLQAEIENLRSTQKAHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNTMGANYKDLYDNIDQMQEHKLSLIPDDLKAAKQSWNDIHKDAEFISKDIAFKQEKTN

SEQ ID NO: 665 - protein, 399 aa, Bacillus Sp.
MATLATVITATNGSTIHALAQEQTAQEQKIENYALGPEGLKKVLAETGSHILVMDLYAKTMIKQPNVNLSNIDLGSGGGELIKNIHLNQELSRINANYWLDTAKPNIQKTARNIVNYDEQFQNYYDTLVDTVKKKDKAGLKEGIGDLIGTIHTNSNEVTEIIKMLEAFKTKLYTNTVDFKNNVGGPDGQGGLTAILAGKQALVPQLQAEIENLRSTQKAHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNTMGANYKDLYDNIDQMQEHKLSLIPDDLKAAKQSWNDIHKDAEFISKDIAFKQEKTN

SEQ ID NO: 666 - protein, 399 aa, Bacillus Sp.
MATLATVITATNGSTIHALAQEQTAQEQKIENYALGPEGLKKVLAETGSHILVMDLYAKTMIKQPNVNLSNIELGSGGGELIKNIHLNQELSRINANYWLDTAKPNIQKTARNIVNYDEQFQNYYDTLVDTVKKKDKAGLKEGIGDLIGTIHTNSNEVTEVIKMLEAFKTKLYTNTVDFKNNVGGPDGQGGLAAILAGKQALVPQLQAEIENLRSTQKAHFDNVLAWSIGGGLGTAILVIGTIAGAVVIVVTGGTATPAVVGGLVALGAAGIGLGTAAGVEVSNHMNSYNEISNKIGELSMKADLANQAVISLTNTKDTLTYLYQTVDQAIMSLTSIQQQWNTMGASYKDLYDNIDQMQDHKLSLIPDDLKAAKQSWNDIHKDAEFISKDIAFKQEKTN

SEQ ID NO: 667 - protein, 423 aa, Bacillus Sp.
MKFPFKVITLATLATVITATNGSTIHVLAQEQTAQEQTAQEQTAQEQTAQEQQIENYALGPEGLKKVLAETGSHILVMDLYAKTMIKQPNVNLSNIDLGSGGGELIKNIHLNQELSRINANYWLDTAKPNIQKTARNIVNYDEQFQNYYDTLVDTVKKNDKAGLKEGIGDLIGTIHTNSNEVTEVIKMLEAFKTKLYTNTVDFKNNVGGPDGQGGLTAILAGKQALVPQLQAEIENLRSTQKAHFDNVLAWSIGGGLGAAILVIGTIAGAVVIVVTGGTATPAVVGGLTALGAAGIGLGTAAGVAASNHMSSYNEISNKIGELSMKADLANQAVISLTNTKDTLTYLYQTVDQAIMSLTNIQQQWNTMGANYKDLYDNIDQMQEHKLSLIPDDLKAAKQSWNDIHKDAEFISKDIAFKQEKTN

SEQ ID NO: 668 - protein, 409 aa, Bacillus Sp.
MKKTPFKVLTFITLASIITTTNGSAIHVFAQDRTLQEQKIEIYTLGPEGLKKELAKTGSNILVMDLYAKTMIKQPNVNLSSIDLGSGGEELIKNIQLNQELSRINASYWLDTAKPKIQKTVRNIVNYDEQFQNYYDTLVDTVKKNDKMNLKEGIGDLIHTIHTNSNEVTEVIKMLEAFKTKLYTNTVDFKNNVGGPDGKGGLTAILAGKQALVPQLQAEIENLRSTQKLHFDNVLAWSIGGGLGAAILVIGAIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWDEIHKDAEFISKDIAFKQEKTN

SEQ ID NO: 669 - protein, 370 aa, Bacillus Sp.
MMKFPFKVITLATLATVITATNGSTIHALAQEQTAQEHKIENYALGPEGLKKALAATGSHILVMDLYAKTMIKQPNVNLSNIDLGSGGGELIKNIHLNQELSRINANYWLDTAKPNIQKTARNIVNYDEQFQNYYDTLVDTVKKKDKMSLKEGIGDLIDTIHTNSNEVTDVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQE

SEQ ID NO: 670 - protein, 414 aa, Lysinibacillus Sp.
MKKFPYKVLSVVTLATVITATNSSSIHALAQEQNVQQQIAQVQNIGNYELGPEGLKKALAETGSHILVMDLYAKTMIKQPNVNLSNIDLGSEGGELIKNIHLNQELSRINANYWLDTAKPKIQKTARNIVNYDEQFQNYYHTLVDFVQKKDKEGLKEGIGDLVSTIDINSKEVTEVIKMLEAFKTKLYTNTIDFKNNVGGPDGKGGLTAILAGKQALVPQLQAEIEQLRSTQKAHFDNVLAWSIGGGLGAAILVIGTIAGGVVIVVTGGTATPVVVGGLTALGAAGIGLGTAAGVVASNHMNSYNEISNKIGELSMKADLANQAVISLTNTKDTLTYLYQTVDQAIMSLTNIQQQWNTMGANYKDLYDNIDQMQDHKLSLIPDDLKAAKQSWNDIHKDAEFIAKDIAFKQEEMN

SEQ ID NO: 671 - protein, 410 aa, Bacillus Sp.
MKKFSYKVLTVATLATIITAANSGTIQALAQEQVTQEQKIGNYYTLGPEGLKKALAETGSHILVMDLYAKTMIKQPNVNLSKIDLGSEGGELIKNIHLNQELSRINANYWLDTAKPKIQKTARNIVNYDEQFNNYYDTLIDTVQKKDKEGLKEGIGDLISTINTNSKEVTEVIKMLEAFKTKLYTNTIDFKNNIGGPDGKGGLTAILAGKQALVPQLQAEIENLRATQKAHFDNVLAWSIGGGLGAAILVIGTIAGGVVIVVTGGTATPLVVGGLTVLGAAGIGLGTAAGVTASNHMSSYNEISNKIGELTMKADFANQAIISLSNAKDTLTYLYQTVDQAIMSLTNIQQQWNTMGANYKDLYDNIDQMQDHKLSLIPDDLKAAKQSWNDIHKDAEFIAKDIAFKQEDKN

SEQ ID NO: 672 - protein, 414 aa, Bacillus Sp.
MMKFPFKVITLATLATVITTTNGSAIHALAQEQTAQKQTAQEQKTENYMLGPEGLKKALAETGSHILVMDLYAKTMIKQPNVNLSNIDLGSGGAELVKNIHLNQELSRINANFWLDTAKPSIQKTARNIVNYDEKFQNYYNTLVDTVKKKDKEGLKEGLGDLIGTIRTNSKEVTEVIKVLQDFKSKLYTNSTDFKKNVGGPDGKGGLTAILAGQQATIPQLQAEIEQLLSTQKKHFDDVLAWSIGGGLGATILAIGAIGGAVLIVVTGGTATAAVVGGLSVLGAAGIGLGTAAGVEATNHMNSYNEISNKIGELSMKADRAKQAVISLASTKDTLTYLYQTVDQAIMSLTNIQQQWNTMGANYKDLYDNIDQMQEHKLTLIPDDLKAAKQSWNDIHKDAEFISKDIAFKQEKSN

SEQ ID NO: 673 - protein, 406 aa, Bacillus Sp.
MKKFPFKVLTLATLATVITATTGNTIHAFAQETNAQEQKVGNYTLGPEGLKKALAETGSHILVMDLYAKTMIKQPNVNLSDIDLGSGGGELLKNIHLNQELSRINANYWLDTAKPQIQKTARNIVNYDEQFQNYYDTLVDTVQKRDKAGLKEGINDLITTINTNSKEVTDVIKMLQDFKSKLYTNSTDFKNNVGGPDGKGGLTAILAGQQALIPQLQAEIEQLSATQKKHFDDVLAWSIGGGLGAAILVIGAIAGAVVIVVTGGTATPAVVGGLSALGAAGIGLGTAAGVTASNHMNSYNEISKKIGELGTKADRANQAVISLTNAKDTLAYLYQTVDQAILSLTNIQKQWNTMGANYTDLLDNIDSMQEHKFSLIPDDLKAAKQSWNDIHKDAEFISKDIAFKQE

SEQ ID NO: 674 - protein, 407 aa, Bacillus Sp.
MMKKFPFKVLTLATLATVITATTGNTIHAFAQETTAQEQKVGNYVLGPEGLKKALAETGSHILVMDLYAKTMIKQPNVNLSNIDLGSEGGELLKNIHLNQELSRINANYWLDTAKPQIQKTARNIVNYDEQFQNYYDTLVDTVQKKDKAGLKEGINDLITTINTNSKEVTDVIKMLQDFKGKLYQNSTDFKNNVGGPDGKGGLTAILAGQQATIPQLQAEIEQLRSTQKKHFDDVLAWSIGGGLGAAILVIAAIGGAVVIVVTGGTATPAVVGGLSALGAAGIGLGTAAGVTASKHMDSYNEISNKIGELSMKADRANQAVLSLTNAKETLAYLYQTVDQAILSLTNIQKQWNTMGANYTDLLDNIDSMQDHKFSLIPDDLKAAKESWNDIHKDAEFISKDIAFKQE

SEQ ID NO: 675 - protein, 406 aa, Bacillus Sp.
MKKFPFKVLTLATLATVITATTGNTIHAFAQETTAQEQKVGNYELGPEGLKKALAGTGSHILVMDLYAKTMIKQPNVNLSNIDLGSEGAELIKNIHLNQELSRINANYWLDTAKPKIQKTARNIVNYDEQFKNYYDILEAAVQKKDKAELKEGINDLITTINTNSKEVTEVIKMLQDFKTKLYDNSIGFKNNVGGPDGQGGLTALLAGNNALIPQLQAEIEKLRSTQTEHFNNVLAWSIGGGLGAFILVAAAIGGAVVIVVTGGTATPAVVGGLAALGAAGIGLGTAAGVTASKHMDSYNEISKKIGELGTKADLASQAVISLTNAKATLTDLYQTVDQAILSLTNIQQQWNKMGANYTDLHDNIDSMQEHKFSLILDDLKAAKQSWSDIHKDAEFISKDIAFKQE

SEQ ID NO: 676 - protein, 409 aa, Bacillus Sp.
MKKLPFKVLAVATLATLITTTNGNTIHVLAQEQTAQEQKVGNYELGPEGLKKALAETGSHILVMDLYAKTMIKQPNINLSNIDLGSEGAELIKNIHLNQELSRINANYWLDTAKPKIQKTARNIVNYDEQFKNYYDILEAAVQKKDKAELKEGLNDLITTINTNSKEVTEVIKMLQDFKTKLYDNSTGFKNNVGGPDGQGGLTALLAGNNALIPQLQAEIEKLRSTQTEHFNNVLAWSIGGGLGAFILVAAAIAGGVVIVVTGGTATPAVVGGLAALGAAGIGLGTASGVTASNHMNSYNEISKKIGELSTKADLASQAVISLTNAKATLTDLYQTVDQAIMSLTNIQQQWNKMGANYTDLHDNIDSMQEHKFSLILDDLKAAKQSWSDIHKDAEFISKDIAFTQEAKN

SEQ ID NO: 677 - protein, 406 aa, Bacillus Sp.
MKKFPFKVLTLATLATVITATTGNTIHAFAQETTAQEQKVGNYELGSEGLKKALTQTGSNILVMDLYAKTMIKQPNVNLSGIDLGSEGAELLKSIHLNQELSRINANYWLDTAKPKIQKTARNIVNYDEQFKNYYDILAAAVQKKDKAELKDGINDLITTINTNSQEVTEVIKMLQDFKTKLYDNSIGFKNNVGGPDGQGGLTALLAGNNALIPQLQAEIEKLRSTQTEHFNNVLAWSIGGGLGAAILVIAAIGGAVVIVVTGGTATPAVVGGLAALGAAGIGLGTAAGVTASKHMDSYNEISKKIGELGTKADLASQAVISLTNAKATLTDLYQTVDQAILSLTNIQQQWNKMGANYTDLHDNIDSMQEHKFSLILDDLKAAKQSWSDIHKDAEFISKDIAFKQE

SEQ ID NO: 678 - protein, 409 aa, Bacillus Sp.
MKKLPFKVLAVATLATVITATNGNTIHVLAQEQTAQEQKVGNYELGPEGLKKALAQTGSNILVMDLYAKTMIKQPNVNLSGIDLGSEGAELLKSIHLNQELSRINANYWLDTAKPKIQKTARNIVNYDEEFKNYYDTLAAAVQKKDKAELKDGLNDLITTINTNSQEVTEVIKMLQDFKAKLYDNSTGFKNNVGGPDGQGGLTALLAGNNALIPQLQAEIEKLRSTQTEHFNNVLAWSIGGGLGAFILVAAAIAGTVVIVVTGGTATPAVVGGLTALGAAGIGLGTASGVIASKNMDSYNAISNKIGQLSTKADLASQAVISLTNAKATLTDLYQTVDQAILSLTSIQQQWNKMGANYTDLHDNVDSMQDHKLSLILDDLKAAKQSWSDIHKDAEFISKDIAFTQETKN

SEQ ID NO: 679 - protein, 406 aa, Bacillus Sp.
MKKLPFKVLAVATLATVITATNGNTMHVLAQEQTAQEQKVGNYELGSEGLKKALTQTGSNILVMDLYAKTMIKQPNVNLSGIDLGSEGAELLKSIHLNQELSRINANYWLDTAKPKIQKTARNIVNYDEEFKNYYDTLAAAVQKKDKAELKDGINDLITTINTNSQEVTEVIKMLQDFKAKLYDNSTGFKNNVDGQGGLTALLAGNNALIPQLQAEIEKLRSTQTEHFNNVLAWSIGGGLGAFILVAAAIAGTVVIVVTGGTATPAVIGGLTALGAAGIGLGTASGVIASKNMDSYNAISNKIGQLSTKADLASQAVISLTNAKATLTDLYQTVDQAILSLTNIQKQWNTMGANYTDLHDNIDSMQEHKLSLILDDLKAAKQSWSDIHKDAEFISKDIAFTQETKN

SEQ ID NO: 680 - protein, 359 aa, Bacillus Sp.
MKKFPFKVLTLATLATVITATTGNTIHAFAQETTAQEQKVGNYALGPEGLKKALAETGSHILVMDLYAKTMIKQPNVNLSNIDLGSEGGELLKNIHLNQELSRINANYWLDTAKPQIQKTARNIVNYDEQFQNYYDTLVETVQKKDKAGLKEGINDLITTINTNSKEVTDVIKMLQDFKGKLYQNSTDFKNNVGGLGAAILVIAAIGGAVVIVVTGGTATPAVVGGLSALGAAGIGLGTAAGVTASKHMDSYNEISNKIGELSMKADRANQAVLSLTNAKETLAYLYQTVDQAILSLTNIQKQWNTMGANYTDLLDNIDSMQDHKFSLIPDDLKAAKESWNDIHKDAEFISKDIAFKQE

SEQ ID NO: 681 - protein, 353 aa, Bacillus Sp.
MAETGSHILVMDLYAKTMIKQPNVNLSNIDLGSEGGELLKNIHLNQELSRINANYWLDTAKPQIQKTARNIVNYDEQFQNYYDTLVETVQKKDKAGLKEGINDLITTINTNSKEVTDVIKMLQDFKGKLYQNSTDFKNNVGGPDGKGGLTAILAGQQATIPQLQAEIEQLRSTQKKHFDDVLAWSIGGGLGAAILVIAAIGGAVVIVVTGGTATPAVVGGLSALGAAGIGLGTAAGVTASKHMDSYNEISNKIGELSMKADRANQAVLSLTNAKETLAYLYQTVDQAILSLTNIQKQWNTMGANYTDLLDNIDSMQDHKFSLIPDDLKAAKQSWNDIHKDAEFISKDIAFKQE

SEQ ID NO: 682 - protein, 343 aa, Bacillus Sp.
MDLYAKTMIKQPNVNLSNIDLGSEGGELLKNIHLNQELSRINANYWLDTAKPQIQKTARNIVNYDEQFQNYYDTLVETVQKKDKAGLKEGINDLITTINTNSKEVTDVIKMLQDFKGKLYQNSTDFKNNVGGPDGKGGLTAILAGQQATIPQLQAEIEQLRSTQKKHFDDVLAWSIGGGLGAAILVIAAIGGAVVIVVTGGTATPAVVGGLSALGAAGIGLGTAAGVTASKHMDSYNEISNKIGELSMKADRANQAVLSLTNAKETLAYLYQTVDQAILSLTNIQKQWNTMGANYTDLLDNIDSMQDHKFSLIPDDLKAAKESWNDIHKDAEFISKDIAFKQE

SEQ ID NO: 683 - protein, 377 aa, Bacillus Sp.
MNNNFPYKLLAVSTFLTLTTTTVVSPAAAFASESKIEQTSTEDISFSVNSEKMKKALQDAGIFAKSMNDYSYLLINNPNVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQVRHFKQVESDGIITVSVPSIPTWIAGGVMIGVARDNLGTLEPLLAQLRQTIDYKITLNRVVGVAYNNIAEMQNAIGLAINALTYMSAQWHDLDSQYSGVLNHIEKASQKADQNKFKFLKPNLNAGKDSWKTLRADAFTLKEGIKTLKMDPVSSKK

SEQ ID NO: 684 - protein, 377 aa, Bacillus Sp.
MNNNFPYKLLAVSTFLTLTTTTVVSPVAAFASESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQIRHFKQVESDGIITVSYPSIPTWIAGGVMIGVARNNLGTLEPLLVQLRQTVDYKITLNRVVGVAYNNIAEMQNAIGSAINALTYMSAQWHDLDSQYSGVLNHIDKASQKADQNKFKFLKPNLNAAKDSWKTLRADAFTLKEGIKTLKMDPVSSKK

SEQ ID NO: 685 - protein, 377 aa, Bacillus Sp.
MNNNFPYKLLAVSTFLTLTTTTVVSPVAAFASESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQIRHFKQVESDGIITVSYPSIPTWIAGGVMIGVARNNLGTLEPLLVQLRQTVDYKITLNRVVGVAYNNITEMQNAIGSAINALTYMSAQWHDLDSQYSGVLNHIDKASQKADQNKFKFLKPNLNAAKDSWKTLRADAFTLKEGIKTLKMEAFSSKK

SEQ ID NO: 686 - protein, 377 aa, Bacillus Sp.
MNNNFPYKLLAVSTFITLTTTTVVSPVAAFASESKIEQTSTQDISLSVNSEKMKKALQDAGVFAKSMNDYSYLLINNPDVNFEGIDIKGYTNLPRQILQDQKNAREHASKWDSHIKKQLLDTLTGIVEYDTKFDNYYDTLVEAINEGDADTLKEGITDLQGEIKQNQAYTQNLIQELAKLRDSIGEDVRAFGGHKDILQSILKNQASGIDEDEKRLNDVLEQVRHFKQVESDGIITVSVPSIPTWIAGGIMIGVARDNLGTLEPLLAQLRQTIDYKVTLNRVVGVAYNNISEMHDAIGSAINALTYMSAQWHDLDSQYSGVLSHIDKASQKADQNKFKFLKPNLNAAKDSWKTLRADAFTLKEGIKTLKMNPVSSKK

SEQ ID NO: 687 - protein, 377 aa, Bacillus Sp.
MNKNFPYKLLAVSTFLTLTTTTVVSPVAAFASESKMEQTSTEDISLSVNSEKMKKALQDAGVFAKSMNDYSYLLIKNPDVNFEGIDIKGYTNLPSQILQDQKNAREHATKWDSHIKKQLLDTLTGIVEYDTKFDNYYDTLVEAINEGDADTLKEGMTDLQGEIKQNQAYTQNLIQELTKLRDSIGEDVRAFAGHKDILHSILKNQASGIDEDEKRLNEVLEQVRHFKQVESDGIITVSIPSIPTWIAGGVMIGVARNNLGTLEPLLAQLRQTIDYKVTLNRVVGVAYNNINEMHNAIGSAINALTYMSAQWHDLDSQYSGVLSHIDKASQKADQNKFKFLKPNLNAAKDSWKTLRADAFTLKEGIKTLKMDPVSSKK

SEQ ID NO: 688 - protein, 377 aa, Bacillus Sp.
MNKNFPYKLLAVSTFLTLTTTTVVSPVAAFASESKMEQTSTEDISLSVNSEKMKKALQDAGVFAKSMNDYSYLLIKNPDVNFEGIDIKGYTNLPSQILQDQKNAREHATKWDTHIKRQLLDTLTGIVEYDTKFDNYYDTLVEAIDEGDGDTLKEGITDLQEEIQQNQAYTQNLIQELAKLRDSIGEDVRAFAGHKDILHSILKNQASGIDEDEKRLNEVLEQVRHFKQVESDGIITVSIPSIPTWIAGGVMIGVARNNLGTLEPLLAQLRQTIDYKVTLNRVVGVAYNNINEMHNAIGSAINALTYMSAQWHDLDSQYSGVLSHIDKASQKADQNKFKFLKPNLNAAKDSWKTLSADAFTLKEGVKTLKMDPVSSKK

SEQ ID NO: 689 - protein, 374 aa, Bacillus Sp.
MNNNFPYKLLAVSAFLTLTTATVVSPVAAFASESKIEQTSTENISLSVNSEKMKKALQDAGGFAKSMNDYSYLLINNPGVNFEGIDIKGYTNLPSQIIQDQKKAREHATKWDTHIKKQLLDTLTGIVEYDTTFDNYYDTLVKAINEGDADTLKEGITDLQGDIKQNQAYTQNLIQELAKLRDSIGEDVRAFGGHKDILQSILKNQASGIDEDEKRLNDVLEQIRHFKQVESDGIITTYVPSIPTWIAGGIMIGVARNNLSTLEPLLAQLRQTVDYKITLNRVVGVAYNNIAEMQNAIGSAINALTYMSAQWQDLDSQYSGVLNHIDKASQKADQDKFKFLKPNLNAAKDSWKTLREDASTLKEGIRILKASSKS

SEQ ID NO: 690 - protein, 351 aa, Bacillus Sp.
MNNNFPYKLLAVSTFLTLTTTTVVSPVTAFASESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDALVEAINEGDADTLKEGITDLQGEIKQNQAYTQNLIQELAKLRDSIGEDVRAFGGHKDILQSILKNQASGIDEDEKRLNDVLEQIRHFKQVESDGIITVSYPSIPTWIAGGVMIGVARNNLGTLEPLLAQLRQTVDYKITLNRVVGVAYNNIAEMQNAIGSAINALTYMSAQWHDLDSQYSGVLNHIDKASQKADQNKFKFLKPNLNAAKVRP

SEQ ID NO: 691 - protein, 351 aa, Bacillus Sp.
MAAFASESKMEQTSTEDISLSVNSEKMKKALQDAGVFAKSMNDYSYLLINNPDVNFEGIDIKGYTNLPSQILQDQKNAREHATKWDKHIKRQLLDTLTGIVEYDTKFDNYYDTLVEAIDEGDGDTLKEGITDLQEEIKQNQAYTQNLIQELAKLRDSIGEDVRAFAGHKDILHSILKNQASGIDEDEKRLNEVLEQVRHFKQVESDGIITVSIPSIPTWIAGGVMIGVARNNLGTLEPLLAQLRQTIDYKVTLNRVVGVAYNNINEMHNTIGSAINALTYMSAQWHDLDSQYSGVLSHIDKASQKADQNKFKFLKPNLNAAKDSWKTLRADAFTLKEGIKTLKMDPVSSKK

SEQ ID NO: 692 - protein, 380 aa, Bacillus Sp.
MKKKIPCKLLAVSTFFTLTTTPVVSPVAAFASESENKVEQISTKDMSLSVNNEKMKKALQDAGVFAKSMNDYSYLLINNPDVNFEGIDIKGYANLPSQIIQDQKKAREHATKWDSHIKKQLLDTLTGIVEYDTKFDNYYDTLVEAINEGDADTLKEGITDLQGEIKQNQVYTKKLIQELAKLRDSIGEDVRTFAGHKDILQSILKNQASGIDEDQKRLDDISEQIRHFKQVESDGIITVIFPSPFTWISGGIMIGVARDNLGTLEPLLAQLRQTIDYKVTLNRVVGVAYNNINGMHDAIGSAINALTYMSAQWHDLDSQYSGVLNHIDKASQKADQNKFKFLKPNLNAAKDSWKTLKTDAFTLKEGIKILKISSKNKAQV

SEQ ID NO: 693 - protein, 325 aa, Bacillus Sp.
MKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKKNQAYTKNLIQELAKLRDSIGEDVRAFGGHKDILQSILKNQASGIDEDEKRLNDVLEQVRHFKQVESDGIITVSVPSIPTWIAGGVMIGVARNNLSTLEPLLAQLRQTVDYKITLNRVVGVAYNNIAEMQNAIGSAINALTYMSAQWHDLDSQYSGVLNHIDKASQKADQNKFKFLKPNLNAAKDSWKTLRADAFTLKEGIKTLKMDPVSSKK

SEQ ID NO: 694 - protein, 375 aa, Bacillus Sp.
MMNKIPYKLLAVSTFLTLTTTSVVSPVATYASEIEQTNNGDTALSANEARMKETLQKAGLFAKSMNAYSYMLIKNPDVNFEGITINGYVDLPGRIVQDQKNARAHAVTWDTKVKKQLLDTLTGIVEYDTTFDNYYETMVDAINTGDGDTLKEGITDLRGEIQQNQKVAQQLIEELTKLRDYIGQDVRAFGSNKDLLQSILKNQGVDVEADQKRLDEVLGSVNYYKQLESDGFNVMKGAILGLPIIGGIIVGVARDNLGKLEPLLAQLRQTVDYKVTLNRVVGVAYNNISEMHKALDDAINALTYMSTQWHDLDSQYSGVLGHIENAAQKADQNKFKFLKPNLNAAKDSWKTLRTDAVTLKEGIKELKVEPVTPQK

SEQ ID NO: 695 - protein, 375 aa, Bacillus Sp.
MIKKIPYKLLAVSTFLTLTTTTVVSPVAAFASGIEQTNNGDMSLSANEVKMKETLKKAGLFAKSMNAYSYMLIKNPDVNFEGITINGYVDLPGRIVQDQKNARAHAVTWDTQVKRQLLDTLTGIVEYDTKFDNYYETMVDAINTGDGDTLKEGITDLRGEIQQNQKVAQQLIEELTKLRDSIGQDVRAFGSNKDLLQSILKNQGADVEADQKRLDEVLGSVNYYKQLESDGFDVMKGAILGLPIIGGIIVGVARDNLGQLEPLLAELRQTVDYKLTLHRVVGVAYNNISEMHKALDDAINALTYMSTQWHDLDSQYSGVLGHIENLAQKADQNKFKFLKPNLNAAKDSWKTLRTDAVTLKEGIKELKVEPVNPQK

SEQ ID NO: 696 - protein, 310 aa, Photorhabdus Sp.
MFKNDIREKAVTSGKSKTSNEGLLDALHLELPDVKAVMSAYKKQTPEFGDFNRKTRLILNASQEFGQLKPAKQRKFSKPGLKKDGVSDGNFIYSKKSLQDFAAHAGYVHNGDYDDEFVNFKDNDRNLANGRLFPGISLIKRPKLSIVKDKEAWKMQQSDEAEAYKVTDIEAFISGIREMYGEENPLHPVIESLIRNHIINNHYVLPTMAGIAGLHAEVQALNNLLTLEDEREGKAVGSRKIGEYMRDMLQSSIFTQRLTTKQSGDDFAACHNCSGILSSPVNVITGKVQSAGSNFSSTLSRYKKSQESPI

SEQ ID NO: 697 - protein, 310 aa, Photorhabdus Sp.
MFKNDIREKAVKFGKSKAPNEGLLDALHLELPNVKAVMSAYKKQTPEFGDFKSKTRLILNASQEFGQLKPAKQRKFSKPGLKKDGVSGGNFIYSKKSLQDFAAHAGYVHNGDYDDEFVNFKDNDRNLAYGRLFPGISLIKRPKLSIVKDKEEWKMQQSDEAEAYKITDIEAFISGIREMYGKENPLHPVVESLIRNHIINNQYILPTMAGIAGLHAEVQALNNLLTLEDERAGKAVGSRKIGEYMRDMLKSSIFTQRLTTKQAGDDFAACHNCSGILSSPVNVITGKVESAGSDFSSTWSRYKKSQESPI

SEQ ID NO: 698 - protein, 310 aa, Photorhabdus Sp.
MFKNDIREKTVKFGKSKAPNEGLLDALHLELPDVKAVMLAYKKQTPEFGDFKSKTRLILNASQEFGQLKPAKQRKFSKPGLKKDGVSGVNFIYSKKSLQDFAAHAGYVHNGDYDDEFVNFKDNDRNLAYGRLFPGISLIKRPKLSIVKDKEEWKMQQSDEAEAYKITDIEAFISGIREMYGKENPLHPVVESLIRNHIINNQYILPTMAGIAGLHAEIQALNNLLTLEDEREGKAVGSRKIGEYMRDMLQSSIFTQRLTTKQAGDDFDACHNCSGILSSPVNVITGKVQSAGSNFSSTLSRYKKSQESPI

SEQ ID NO: 699 - protein, 310 aa, Photorhabdus Sp.
MFKNDVYEKTVKSGKGKTSDGMLLDALYLDIPNARAVMSAYKKKTPNLPDFNEKTQLILSASKKFGQLKPAKQRAFSEPGLKANGVSDGKFIYSKNSLSNFAAHAGYEHNGHYDDEFVNFKDNDRNLAEGKLFPGINLIRRPLIEKNKETNEWEIKQIEVGAYKVSDIDSFILGINNMYSEAGTSLHPIIESLIRNHIINNDYVLPTMAGIAGLHAEVQALNHLLILEDKRAGKTIGSRKIGEYMRDMLKSSIFTQRLTTIQAGDDFAACHNCSGILSAPANVITGKVESAGNNFSSTLSRYKRSQESPI

SEQ ID NO: 700 - protein, 315 aa, Photorhabdus Sp.
MFKNNIREKAIKKLHFKDKNPDITRLDGLHLELPDNKAVTSAYQQHIPELKDFSKKTQLILNASKEFGQLKPAKQRSFSKAGLKADGISDGRFTYAKKSLENFAAHAGYEHHGHYDDEFVNLKNNEKNLADGKLFPGINLIKRQKLSKVKNEKTKKWETQLRDEAEAYKVNNIESFISEIKDMYKQANKPLHPITESLIRDHIANNEGVLPTMAGIAGLHAEVQALNNLLILADERAGKPIGSRKIGEYMRDMLESSIFTQRLTTKQAGDDFAACHNCSGILSTPANVITGKVASAGSNFSLTLAQYKASQESPI

SEQ ID NO: 701 - protein, 315 aa, Photorhabdus Sp.
MFKNDIRKKTIKKAHSKNKNSDTTLLDRLHLEIPDTNAVTTAYQQQIPELKDFSKITQLILSASKEFGQLKPAKQRNYSKPGLKDDGISDGRFAYGKKSLENYAAHAGYEHNGRYEDEFVNFKNNDKNLADGKLFPGISLIKHPKLLRVKNEKTKKPETQLREEAEAYQITDIESFISGIKEMYNQANKPLHPITESLIREHIINNEGVLPTMAGIAGLHAEVQALNNLFISGDKRAGKSIGSRNLGEYIRDMLESSIFTQRLTTKQAGDDFAACHNCSGILSSPVNVITGKVASSGSNFSLALSRYKTSQESPI

SEQ ID NO: 702 - protein, 487 aa, custom Sp.
MSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGK

SEQ ID NO: 703 - protein, 488 aa, custom Sp.
MMSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIQLTREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGK

SEQ ID NO: 704 - protein, 430 aa, custom Sp.
MSDQSALQGQPLNGEPIISAQFKYEIDYNNAARVVITTGLDQIPMVGFVLGALVEIFWPSSQQDVWSEIEAKVEQLVDAKISELVYQQVQESLAGLHNNLNEYLWAVKNTDPNYITQKFNIAHGHFIQELPHFQSKGYELLLLPLFAQFANLHLSLLRDGVIYGASWGWGEEVQQHLREQIVETIQQYVQYTDKTYTEGLQNTQSKAPSNKHYTEPFNTVNRYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGPGGSDHSFSYPDEILSSIKIMSADCAVFGFKFKQYVASPAKISVKTGKLIQEWDRIQTVPGVD

SEQ ID NO: 705 - protein, 514 aa, Lactococcus Sp.
MIKKAKMEKMMTKKLIRNLFILLLFTSIIAVFGVGKVYAQGSVSSKSLQVSADGSDYYTLGSDFYNHFVEPTTVDLTKNKVVYNKQTLIVFNGRIDKWKMSFINQDSSGKSWFKFLSYPEATKGDIKITYTTDGMNYSDNKPSLEQLKGYMVELLKPIVYPDDANNQENDIEVSFQLSPDTDYILSNFNLNKQFIPFSGESWLQNYSPDPFFTDRNQLQFIYPNYSRGVAVEYVDEEGNKIHNSQTISGSKGDVYDASTDQYKLVLDGYTLDTTKLPQNSTGNFEEELQTVTYIYSKNPVVAADVTVRYVDIENNPISEDIILQGNIGENYYTDKKDIKDYTLKEVQGNSSGQFSEKAQTVSYVYTENELPIATGKVVVKYIDTDGKSISKDVVRSGTVGEDYITEEKKISGYTLQEIKGNSKGKYTAKVQTVTYVYAKNEIIKAKDKLISSETKSKNKTNPKVKNSSHVNPKRLPETAENKKKSIIIFLSGFTLIIIGLAIITFRLKKLVIKK

SEQ ID NO: 706 - protein, 292 aa, Microcoleus Sp.
MTVAGDRLTNFPDSECVGQPDGISWDWQSSEGLPYLTCSLLSRWSHGFFTRDFSPRGPIDLTEVLEPGAKVYRLQQVHGNAVLKTSELSPVVALGPETAAPSYAEADGLVAERELEALWVCSADCVPVLIADDRTGLVAAVHAGWRGTAAKILPETIAQLVAQGSQLENLKIAMGPAIAGKVYQVSVEVAAELGATIAPKSAVSATADGILEFLHQLPETPVFADPEPGKVRLDVRLCNALQLQQLGIDFSQVAIAPFCTYSDSARFFSYRRDRLKKVQWSGIVSACGTSSF

SEQ ID NO: 707 - protein, 292 aa, Oscillatoria Sp.
MTVAGDRLTNFPDSECAGGADGISWDWQSSEGLPYLTCSLLSRWSHGFFTRDFSPQGPIDLTEVLEPGAKVYRLQQVHGNAVLKTTELSPVAAPGPETAASSYAEADGLVAERELEALWVCSADCVPVLIADDRTGLVAAVHAGWRGTAAKILPEAIAQLVAQGSQLENLKIAMGPAIAGEVYQVSVEVAAELGATIAPLSAVSATADGMLEFLHQLPETPVLADPEPGKVRLDVRLCNALQLQQLGIDLSQVAIAPFCTYSDSARFFSYRRDRLKKVQWSGIVSASRTSSF

SEQ ID NO: 708 - protein, 1239 aa, unknown
  environmental sample
MAKVFYPGSDELEVVITDIGFHANDHAVETLDFKTGNETLIGPQHKQRLRQLEVVDQLYGPLHIGSVTVTRQALDALGATTNGQPLNGDNTFFRTPHRFFLNTLQFNPVDIETRIKLTTNGNDYRLPTLLFEIASERSSIAPPLLNSPPETASEPARYRSALEKLLNAAQQLNTASLAQRTFSWVNKAKSNVLIPTGFGLQAFGIYSGLRGLQDAIRNKNAYQTVFNGASVTAELASIGVEAAVSRQAMQMLKAGQSSLGSFAKTTFALRLGRGSGLIASVLTLPFDIVAAVDAFKAAAKTTGKDATDHYVSAALSVTSATMSVMIGAAALAGFSSAGPVGLAAGLILAVGSQIWGAIREVDEIDDYITLTVHERLRTGWFAFWTISPDDDIQARYTVAKATAEHTKQLRANALALLQGTLKDSTEAIVNGKFGVELEQVTYNTWNWWTGERYQATRVRPRITDSDDFIDAHDGVTADTPGAVLGTSAEHKGIHWYIGGGNDTIVGVEKKPNVFHYGAGIKKLTGGEKDDVFIFEGSRQAITRSTINRSPNWLFGGTGNDTVILSGNIRSEQEQRLGYHVDLEAGHLSVITPASQKAPTGHYRHAVMESVENVEILEGGANVIKGTTGPNIIKSRGNDSIEAGAGDDQIFLLGGNSRDADGGPGEDVYAIAHKPGRVSITEDGRGNSVIALDWRADLIDSWRVKEGQLIVTSCFDSDDWQRREVVINNVYQTSDPGLLQNNKLTFMTKDGYHLVPDLPDMIGQGHSLDIEAVVVQLGTPRNPSILHDQKEHQVPHDKDSSYFLSRRIEFSTLDIKQKSDFCTTLHLDYAHSELTRVEAHYNAYVSQEGEASTARYGECSLTLYFGVRRVLLKNLASSDERYSARDPRTGRRAFSVVGLHHIIILVMNDGSSYRLTVPSPDEGQMLDEKFISKDPVKWKTVAPQSISLTKKKYAFLLPLDKKPYAMGRRATCALLTSPSEQTGVEVLIGEGATYLVHLSQDMTLRLSTPGALASANPQLPHASVWELDATHLGQVEIKLDANLLQVGRTVIHLPVYEAQDLIDPIRVITAQGIVYAVDVLFERVYVEALDGRYFTPPVDPTAPWPSELSGLTSKKLKVMNVALKDGSAGALSYHLGTRQWTLETDKARPIVAQDLKKTNLCDHHLSLYRDLAREGLSQIPPTDDGALRLLREKCVALAESLTPGNSKSLVQTLTLSLAFGMSAPQLSGLLSLQGLLPAYL

SEQ ID NO: 709 - protein, 1708 aa, Enterococcus Sp.
MKKTKILNSLMIIGLVLGSMNDAVVQAISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFFFWKRKMSKKSFDKQ

SEQ ID NO: 710 - protein, 1708 aa, unknown
  environmental sample
MKKTKILNSLMIIGLVLGSMNDAVVQAISSIESKTEKTSLVEKKQFSIEPNKEEDKINNKKIAIKDESNEKSIEKNKRTSARNNNPSDNFDSVQGNNGNYFKPTTDATLLKIGEEQAARVQSDLSKTTFNISDLQHEKDDSFEVLNFSKSAFPNDKGLVMWPLGGGRNDVYWTQVDSNSGIWRMRLYASMASTSEPYLNARFTRLKYGSVSGNEVFVFPRVAYLSNPTSNVNDMKPFLMAATFEVRLPTAEEEIGKIVATAKEGTHKLMQNTQPIPNPETYLDVKNTRGKVEYSWKIAPDTTKVGKQDTKILVKDESGREIEAVVPITVEPLAVEIEGKPGPFDIYQYDKLPDVTEYFEVTNLYGTYTLKWFDDVNTDSPGEQTWRAKVTTSDGREATASIQMDVTPHEGLKVNLKSIEDRKLGYNYPTFATNFRDYIDSVTMHGEPVELRDLEFIPQESVEADYRIGGLQTLKLTVQTKHPNSGVMIKGTGEVTLNVLWDHSILMKSINGESAGSFTLRTDNSGNETAKVVFGMGIPTSINTAVGPQSSPFSLYYSFEVLRGETVVYSQEVTNRATWQQIMDKFGDSTGTIDVRYGDVIKIYHPERTPNSSVLMIDEQEQDYTYDTAYAYYKITPYGFDPFPLLEAEASQKSFVLGENTKTIDPASLIKNVTINGRVVDSSLYEVESLIDFDTSSIGTRKMKLKVTMNDGLSAEEFEVDYQVKWGSTFVLKGLGDETVGAFSLLKENDQWALHASQGVNGTDLSQPVNNHFGRDIYYGIEVIENITTKYQYNVLGNQSIRDGIEGFNQGKPLTVKQGDVIKVYHAEPTGNSLLMQDEIAKDFTMGSNDAYYEVTEHGLEPILAISTDTKPQEFSLGDDATEIDGTQLINYVTINGTELTPDLYTVKQLGNFDTTTVGQKELAIQFDTKDGVVSKVITVPYEVKWGRTIVMKSSTGGSAGVFSLQTTNTTRQLKIHHGFDSPLDERLGNDQDLYYSIEVLRGERVHYSQEVPGRVTLQDVINSFGTNGTQAVTVQLDDVIKIYHPQKSPGSSVLMVDELEEDFTYGSDYAYYKVTTYGFEAMPVMEVHTANKAFYLAQDVTTAADAELIDRVTINGKTVDPEEYTIERRSEIDTTTIGNKNVSMRVKMNDGLSSVQLELPYQVKWGSTFVLKGEEKEGKRGIVGSFSLLDQNDELAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVKNGEFEPITMIYADVASQELVLGEDTSEVDVTTLIENVAFNGQSLNTELYKVEQMGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVSPGDIVKVYHVDTSNNLLMAEENERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFVFWKRKMSKKSFDKQ

SEQ ID NO: 711 - protein, 1689 aa, Enterococcus Sp.
MNDAVVQAISSIESKTEKTSLVEKKQFSIEPNKEEDKINNKKIAIKDESNEKPIEKNKRTSARNNNPSDNFDSVQGNNGNYFKPTTDATLLKIGEEQAARVQSDLSKTTFNISDLQHEKDDSFEVLNFSKSTFPNDKGLVMWPLGGGRNDVYWTQVDSNSGIWRMRLYASMASTSEPYLNARFTRLKYGSVSGNEVFAFPRVAYLSNPTGNINDMKPFLTKATFEVRLPTAEEEIGKIVATAKEGTHKLMQNTQPIPNPETYLDVKNTRGKVEYSWKIAPDTTKVGKQDTKILVKDESGREIEAVVPITVEPLAVEIEGKPGPFDIYQYDKLPDVTEYFEVTNLYGTYTLKWFDDVNTDSPGEQTWRAKVTTSDGREATASIQMDVTPHEGLKVNLKSIEDRKLGYNYPTFATNFRDYIDSVTMHGEPVELRDLEFIPQESVEADYRIGGLQTLKLTVQTKHPNSGVMIKGTGEVTLNVLWDHSILMKSINGESAGSFTLRTDNSGNETAKVVFGMGIPTSINTAVGPQSSPFSLYYSFEVLRGETVVYSQEVTNRATWQQIMDKFGDSTGTIDVRYGDVIKIYHPERTPNSSVLMIDEQEQDYTYDTAYAYYKITPYGFDPFPLLEAEASQKSFVLGENTKTIDPASLIKNVTINGRVVDSSLYEVESLIDFDTSSIGTRKMKLKVTMNDGLSAEEFEVDYQVKWGSTFVLKGLGDETVGAFSLLKENDQWALHASQGVNGTDLSQPVNNHFGRDIYYGIEVIENITTKYQYNVLGNQSIRDGIEGFNQGKPLTVKQGDVIKVYHAEPTGNSLLMQDEIAKDFTMGSNDAYYEVTEHGLEPILAISTDTKPQEFSLGDDATEIDGTQLINYVTINGTELTPDLYTVKQLGNFDTTTVGQKELAIQFDTKDGVVSKVITVPYEVKWGRTIVMKSSTGGSAGVFSLQTTNTTRQLKIHHGFDSPLDERLGNDQDLYYSIEVLRGERVHYSQEVPGRVTLQDVINSFGTNGTQAVTVQLDDVIKIYHPQKSPGSSVLMVDELEEDFTYGSDYAYYKVTTYGFEAMPVMEVHTANKAFYLAQDVTTAADAELIDRVTINGKTVDPEEYTIERRSEIDTTTIGNKNVSMRVKMNDGLSSVQLELPYQVKWGSTFVLKGEEKEGKRGIVGSFSLLDQNDELAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVKNGEFEPITMIYADVASQELVLGEDTSEVDVTTLIENVAFNGQSLNTELYKVEQMGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEENERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDVDGISAETGLGEGSAAEGDESKLPQTNQTINRVLPYIGACFLLIVGFVFWKRKMSKKSFDKQ

SEQ ID NO: 712 - protein, 1487 aa, Enterococcus Sp.
SIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQEFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSDVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDNSKNLLMTEKRERN

SEQ ID NO: 713 - protein, 1416 aa, Enterococcus Sp.
MKKTKILNSLMIIGLVLGSMNDAVVQAISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYDYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTEGGVSSTDIEVTYAVNWGSTTNLNNCRGKRVRSS

SEQ ID NO: 714 - protein, 1385 aa, Enterococcus Sp.
MKKTKILNSLMIIGLVLGSMNDAVVQAISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKQGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMVDEQEQDYTDDTTYAYYKITTDGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADG

SEQ ID NO: 715 - protein, 1368 aa, Enterococcus Sp.
RKFEINKYHKLPDVTEYFEVTNMYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFFFWKRKMSKKSFDKQ

SEQ ID NO: 716 - protein, 1339 aa, Enterococcus Sp.
KWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEDPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFFFWKRKMSKKSFDKQ

SEQ ID NO: 717 - protein, 1263 aa, Enterococcus Sp.
MQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVST

SEQ ID NO: 718 - protein, 1242 aa, Enterococcus Sp.
QAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSEL

SEQ ID NO: 719 - protein, 1210 aa, Enterococcus Sp.
LWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFFFWKRKMSKKSFDKQ

SEQ ID NO: 720 - protein, 835 aa, Pantoea Sp.
MPTVPTSQRQILDQGLPAPQVSVQTNPDTFGAGWGEVGNRIAGIFAQEQHKANVAQTQDAVLQFQSFADDQFNNTDSGLYTKQGKNAVGQSEAVLSNIRGKAEELSKQVPEAMRRDFIQQINQAGQQYKRQASTYEIGQVRQYEEGQFKALQESTVTAAQGQYNDPQAFTSTVKQGFTAIDQFADAHGWSDEERSNAKNQLKERSADGALSAAANQNYMDFIAANGEPGDYDGAVRVSGSTGDARGLRNNNPGNIEAGQNNWEGQAGSDGRFAKFVTPEHGIRALGKNLLSYGDKGFDTVNEIVNRWAPASDGNNTTAYVKALCEQLSVKPDDQLNLSDLNVLKKLSAGIVKHENGSIPYSDSQLDTGLRAALGLTALDSPKRYTGNVAFDAASPQAQASYLRQAKSLQGEARTQLKAQLTDVISDAKASYLKGVEYPNPPSQAQLISAYGYREGNQRFADLENQRVAGQYIGSFRNMPSSSITNYVADLKTQLGSGEGFAGRADAYDHVEAAAKQVISLRESNPYQAAMDMGAYKPIASTNPADITSEIKSRTAATDQLKSLGINAPILSKEEAASISERVRGTTDVNQSISLLQSFGRDLQPQALRSVAASIAPDSAATAYSALILGTDDNQYNNRSPSIPYSQFVSYKPTMNKYEVAKTILQGDQLINPTKAQKDAGISAVKLPADDKLKQTFDDEIGNAFSHNPQARQMAWSIYKSAYAGLAYTSGDSDGVNTKAVDSDIAEKAIQMATGGVIKGFNGGDVVMPFGMDKSTFKDRYTAAAGEALKSAGLNPAAQSNFIPVNVGDSQYRLVTGSGRWATDPKTGAPITVRVQ

SEQ ID NO: 721 - protein, 836 aa, Meta Sp.
MPTVPTYNSRQTSDQGLPAPQVSVQTSPDNFGAGLAETGNRIAGIFAEEQHKANVAQSQNALLQFQSFAEDQFNNTDNGLYTKQGKNAVGQSELVLSNIRGKAEELAQQVPESMRQQFIQQIDQAGMQYKRQANMYEIGQVKEYEEGQFKALQQATVTTAQAQYNDPQAFTATVKQGFTAIDQFADAHGWSDEERASAKNKLKEQSADGALSAASTQNYMEFISRNGEPGDYAGAVRVSGSTGDSRGLRNNNPGNIEAGKNTWDGQTGSDGRFAKFVTPEHGIRALGKNLMSYGSQGYDTVNEIVNRWAPASDGNNTAAYVKALCSQLGVKADDQLNLTDINVLKSLATGIVKHENGSVPYSPDQLDTGIRAALGLTALDTPKRYTGNAAFDAASPEAQAAYLRQAKSMQGQAQTQLKAQLTDQLSDAKAAYMKGVEFSNPPSQEQLIAAWGYREGTQRFNDLQNDRVAGQYIGSFRTMPTASIQQYVAGLKTELGNGEGFASRSGAYDHVAAAAKQVISMRESNPYQAAMDIGAYKPITGSSPADITAEVKNRAAASGQLQQIGINAPILSREEAANVSNQVRGTTDVNQSISLLQSFGRNLQPDALRKVASAIAPDSAATAYSALILGTPDNQYDNRSPVIPYSQFVPYKPTMNKYDVAKTILQGDQLINPTKAQKEAGISPVKLPSDDKLKQTFDDAVGSSFSHNPQARQMAWSIYKSAYAGLAYTNGDNDGVNTKNVDSDIAEKAVQMATGGVIKGFNGGDVVMPFGMDKSTFKDKYTAAAGEALKSAGLNPAGQNNFIPVNVGDSQYRLVTGSGRWATDPRTGAPVIVRIQ

SEQ ID NO: 722 - protein, 527 aa, unknown
  environmental sample
MNKKTLISSLLITLAFLFLNVQKVSAAIDYNLFNYNYPVSAYYPKSSDKANVMGRIIKINNVRNDYSVSIPMDISQNSEGKLNYFGLTTSTNAYFTHDSGNSITNAGSLTGPNTLVGPGLQNPVKLPIPSSTITIDGQTYYFNYYVVQVVTEKVISPINEVQGNNYALQPLDTLPANANFAWAYYSDSPGAIIHYKTEDGTELLTSPTLIGESGDTIPSEVRDFTGYTLISVPEEDSFKKAQLTNLTYVYRKNPVATATVTVKYIDTQGNSISDSIPLSGNVDQEYTTEQKIISGYTFKEVQGNKSGLFSTTPQTVTYIYTKNPIEIKTGSVTIKYVDTNGNSISDVITKSGNVGSSFDSEQKIILGYTFKEVQGNKSGLFSTTPQTVTYIYTKNPIEIKTGTVTIKYVDTNGNSISDEITKSGNVGSLYTSEQKKILGYNFKEIQGIAEGQFTIESQTVTYVYTKISTPTIIKTSVIPPKTLSVKTLPKESLPETGDKFFGFTLLSGSLLILVSTTLYLLKSRKYK

SEQ ID NO: 723 - protein, 523 aa, Lactococcus Sp.
MNKKSLISSLLLALAFLFFNVQKVSAAIDYNLFNYEYPVSAYYPKSSDKANVMGRIIKINNVRNDYSISIPMDFNQNSEGKLNYFGLTTSTNAYFTHDSGNSITNAGSITGPDTLVGPGLQNPVKLPIPNKTLTVDGQTYFFNYYVVQVVTAKVVSPINEIPGNNYALQPLDTLPANANFAWAYYSDSPGAVIHYKTEDGTELLTSPTIIGESGDSIPSEARDFTGYTLVSIPEADTFKKAQLTNLNYIYKKSPVAGATVTVKYVDTNGFPISDPISLSGNIDQEYTTEQKNIAGYTFKEVQGNKNGQFTTEPQAVTYVYTKNPIATGTVTIKYVDTNGKSISDEIIKSGNVASPFSTEQKNIAGYTFKEVQGNINGQFTTEPQTVTYVYSKNPIATGTVTIKYVDTNGKSISDEIIKSGNIGNSYTSEQKKISGYNFKEVQGITEGQFTNDPQTVIYIYTKNPTPQVIKTSKIPSKTLAVKTLPKEALPETGDTFSPFALLTGSLLILTSATLYLLKTKKHE

SEQ ID NO: 724 - protein, 494 aa, Lactococcus Sp.
MNKKYLISSLLLALAFLFFNVQKVSAAIDYNLFNYEYPVSAYYPKSSDKANVMGRIIKINNVRNDYSISIPMDFNQNSEGKLNYFGLTTSTNAYFTHDSGNSITNAGSITGPDTLAGPGLQNPVKLPIPNKTLTIDGQTYFFNYYVVQVVTAKVVSPINEIPGNNYALQPLDTLPANANFAWAYYSDSPGAVIHYKTEDGTELLTSPTIIGESGDSIPSEARDFTGYTLVSIPEADTFKKAQLTNLNYIYKKSPVAGATVTVKYVDTNGFPISDSISLSGNIDQEYTTEQKNIAGYTFKEVQGNINGKFTTEPQTVTYVYSKNPIATGTVTIKYVDTNRKSISDEIIKSGNVASPFSTEQKNIAGYTFKEVQGNTNGQFTTEPQTVTYVYSKNPIATGTVTIKYVDTNGKSISDEIIKSGNIGNSYTSEQKKISGYNFKEVQGITEGQFTNDPQTVIYIYTKNPTPQVIKTSEIPSKTLAVNTLPKEALSQPLS

SEQ ID NO: 725 - protein, 462 aa, Providencia Sp.
MNIKTFKFIDKDSNGIVVNFDNGNKKTVTISLFLDNENIETISTNNDHYLFKVGKSGNYHVTISFADSNKNILHLIDSPVSYRLPHQKINKKIKAEVKSKTINHKIDGIDKYFLEIKSEIKSSHFIMDALSNELVNSKLILIKLNIRSSVTQCEYFNLYGENNYDDLLELSQRLEKLDCVSYCCICPNTTGYHPPKLPINSQTIEEKISSDEITPDFTELQKYLDAPMGMNVREAWAKNIDGSLAVVRHMDFGVYQNHEDFKDANLAVVSSRPETQDCNHGTASTGCIIATKNEFGVTGIAHGCQFYFYDTDDLDQLTDDTQPGDIVSFDLQFRIENKLLPITSIRNWWERIKIMVDKGATVLLAAGNGGLDLSKPEVMDDFGDNGSMLVGACYHHTGKRALFSNYNQTSSLINSWGDWSVTTTGYGKLQKHPGNERNYTDRYSGTSSATPLCSGALALIQS

SEQ ID NO: 726 - protein, 552 aa, custom Sp.
MKTKINLFALFAFCSSLSFGQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDAGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKI

SEQ ID NO: 727 - protein, 545 aa, custom Sp.
MKTKINLFALFAFCSSLSFGQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKI

SEQ ID NO: 728 - protein, 552 aa, custom Sp.
MKTKINLFALFAFCSSLSFGQDSQPKMANDQNSIIYVCFSKGINSEKTAFSRNADLERFSRENHISFKYDLDFTDSKLDEMARNSKAIGNSGESVEKLKRIYKADLPLQNKETTEKIIHTLERFPEIEYVSVMSAEPIEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSALEVKIYPNPSSSSIAIQSNENKKLDIEIINLQGRTVIKSSVLSNEKIDISQLPTGQYIININEGQRRVVEKLTKL

SEQ ID NO: 729 - protein, 552 aa, custom Sp.
MKTKINLFALFAFCSSLSFGQDSQPKMANDQNSIIYVCFSKGINSEKTAFSRNADLERFSRENKISFKYDLDFTDSKLDEMARNSKAIGNSGESVEKLKRIYKADLPLQNEETTQKIIHTLERFPEIEYVSVMSAAPIEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSPLEVKIYPNPSSSSIAIQSNENKKLDFEIINLQGRTVIKSSVLSNEKIDISQLPTGQYIININEGQRRVVEKFTKL

SEQ ID NO: 730 - protein, 552 aa, custom Sp.
MKTKINLFALFAFCSSLSFGQDSQPKMAQDQNSIIYVCFSKGINSEKTAFSRNADLERFSRENKISFKYDLDFTDNKLDEMARSSKAIGNSSESVEKLKRIYKADLPLQNEETTQKIIHSLERFPEIEYVSVMSAAPIEPPLVNAFVATPDLESIQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTLSPLEVKIYPNPSSSTIAIQSTENKKLDFEIINLQGRTVIKSSVLSDEKIDISQLPTGQYIININEGQRRVVEKFTKL

SEQ ID NO: 731 - protein, 552 aa, custom Sp.
MKTKINLFALFAFCSTLSFGQDSQPKMANDQNSIIYVCFSKGINSEKTAFSRNADLERFSRENHISFKYDLDFTDSKLDEMARSSKAIGNSGESVEKLKRIYKADIPLQNKEASEKIIHTLERFPEIEYVSVMSAEPIEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSASEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTFGNRVDVQGWGSSVMAAGYGSYAKYDNDNNRTYNYFSGTSSATPVVSSAAILIQSFYRQTTGQYLTPSAMKNLLISTGIPQGGTVTGQKIGPLPNVKNAILQLESNFVAPVKTLPSLEVKIYPNPSSSSIAIKSSENKKLDIEIINLQGRTVIKNSVLPNEKIDISQLPTGQYIININEGQRRVVEKLTKL

SEQ ID NO: 732 - protein, 552 aa, custom Sp.
MKTKINLFALFAFCSSLSFGQESQPKLNQDQNSIIYVCFSKGINSEKTAFSRNADLERFSRENNISFKYDLDFTDRKLDEMARNSKAIGNSSESVEKLKRIYKADLPLQNEETTQKIIHSLERFPEIEYVSVMSAAPIEPPLVNAFVATPDLESIQTYLNDNPGINAKYAWSRGITGQNIRVRDVEYGFYKTHEMLTNQNSIQLEPGYSPNAGLANNNYRDHGTAVVSILGSIKDNIGLTGAAYSTSEIKGYMEWTTVGYNRASAVSRSINASQSGDIILYEMQTGGKDGQYCPAEYDKVIWDLTKAATDSGIIIIAAAGNGNQNLDDPFYSTYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTLSPLEVKIYPNPSSSTLAIQSTENKKLDFEIINLQGRTVIKSAVLPNEKIDISQLPMGQYIININEGQRRVVEKFTKL

SEQ ID NO: 733 - protein, 554 aa, custom Sp.
MKTKIQLFALFTFCSSLSFGQNPQNQPNRNNDQNSNIYVCFSKGINSEKAAFSRNSDLERFARENKISFTYDLDFTDSKLDEMARSSKAIGNSGESVEKLKRIFKADLPLQNEETTQKLIQTLERFPEIEYVSVMSSTPIEPPLVNAFVATPDLESLQTYLNDNPGINAKYAWSRGITGQNIRVRDVEYGFYKTHEMLANQNSIQLEPGYSPNSGLSNNNYRDHGTAVVSILGSVKDNIGLTGAAYSASEIKGYMEWTTVGYNRASAVSRSINASQAGDIILYEMQTGGKDGQYCPAEYDKVIWDLTKAATDSGIIIIAAAGNGNQNLDDPFYASYMARGNSGAIIVGAGSPNTTHSKLSFSTYGNRVDVQGWGSSVLAAGYGSYAKYDNDNNRTYNYFSGTSSATPTVASAAILIQSFYRQTTGQYLTPSAMKNLLISTGIPQGGTVTGQKIGPLPNVKNAILQLESKSATSVKTLPSLEVKIYPNPSTSYIAIQSSENKKLDFEIINMQGRSVIKSSVSSDEKIDISQLPTGQYIININEGQRRVVEKFTKL

SEQ ID NO: 734 - protein, 551 aa, custom Sp.
MKTKIKLFALFMFCCSLSFGQKPSNGDIGQNANIYVCFSKGINSEKAAFSRNPELERFARENKISFTYDLGFTDEKLDEMARNSKLNGNSGESVEKLKRIFKADLPLQNEETAQKLAQALERFPEIEYVSVMSSTPIEPPLVNAFVATPDLESLQTYLNDNPGINAKYAWSRGITGQNIRIRDVEYGFYKTHEMLANQNSIQLEPGYSPNSGLSNNNYRDHGTAVVSILGSVKDNIGLTGAAYSASEIKGYMEWTTVGYNRASAVSRSINASQAGDIILYEMQTGGKDGQYCPAEYDKVIWDLTKAATDSGIIIIAAAGNGNQNLDDPFYASYMARGNSGAIIVGAGSPNTTHSKLSFSTYGNRVDVQGWGSSVLAAGYGSYAKYDNDNNRTYNYFSGTSSATPTVASAAILIQSYYRQTTGQYLTPAAMKNLLISTGIPQGGTVTNQKIGPLPNVKNAILQLESKSATPVKALPPLEVKIYPNPSTNYIAIQSNENKKLDFEIINMQGRSVIKGSVSSDEKIDISQLPPGQYIININEGQRRVVEKFTKL

SEQ ID NO: 735 - protein, 554 aa, custom Sp.
MKTKIQLFALFTFCASLSSGQNQKNQLNQNIGQNAAVYVCFSKGINSEKAAFSRNSDLERFARENKISFAYDLDFTDSKLDEMARSSKAIGNSGESVEKLKRIFKADLPLQNEATTQKLIQTLERFPEVEYVSVMSGTPVEPPLVNAFVVTPDLESVQTYLNDNPGINAKYAWSRGITGQNIRVRDVEYGFYKTHEMLANQNSIQLEPGYSPNSGLSSNNYQDHGTAVVSILGSVKDNIGLTGAAYSASEIKGYMEWTTVGYNRASAVSRSINASQAGDIILYEMQTGGKDGQYCPAEYDKVIWDLTKAATDSGIIIIAAAGNGNQNLDDPFYAPYMARGNSGAIIVGAGSPNTTHSKLSFSTFGNRVDVQGWGSSVLAAGYGSYAKYDNDNNRTYNYFSGTSSATPTVASAAILIQSFYRQTTGQYLTPSAMKNLLISTGIPQGGTVTGQKIGPLPNVKNAILKLESGSKGKTESLPSLAVKIYPNPSTTYIAIQSNEDKRLDFEIINIQGRSILKNSVSSDEKIDISQLPRGQYIININEGARRVVEKFTKL

SEQ ID NO: 736 - protein, 551 aa, custom Sp.
MKTKIKLFTLLLFCFFLSFGQNPSDRGIGQNSNIYVCFSKNINSEKAAFSKNPELEEFVRENDISFVYDLGFSDRKLNEMAANSRLNGNSGESVEKLKRIFKADVPVQNNETAQKLAQALEKFPEIEYVSVMSSTPIEPPLVNAFVATPDLESLQTYLNDNPGINAKYAWSRGITGQNIRIRDVEYGFYKTHEMLANQNSIQLEPGYSPNSGLSNNNYRDHGTAVVSILGSVKDNIGLSGAAYSASEIKGYMEWTTVGYNRASAVSRSINASQAGDIILYEMQTGGKDGQYCPAEYDSVIWDLTKAATDSGIIIIAAAGNGNQNLDDPFYASYRARGNSGAIIVGAGSPNTTHSKLSFSTYGSRVDVQGWGSNVLAAGYGSYAKYDNDNNRTYNYFSGTSSATPVVASAAILIQSYYRQTTGQYLTPAAMKNLLISTGIPQGGTVVNQKIGPLPNVKNAILQLESTLTLSTKTLPPLEVKIYPNPSTNYIAIQSKENKKLDFEIINMQGRSVIKGSVSSDEKINISDLPPGQYIINITEGQRRVVEKFTKL

SEQ ID NO: 737 - protein, 552 aa, custom Sp.
MRTKIRLFTLFIFSFFLSFGQNPSNQLDKSQNSNIYVCFSKNINSEKAALSKNPELAEFVKTNDISFVNDLGFSDRKLDEMIKNSRANGNSGESVEKLKRIFKVNIPLQNNEDAEKLARTLEKFPEVEYVSVMSSTPIEPPFVKAFVATPDLESLQTYLNDNPGINAKYAWSRGITGQNIRIRDVEYGFYKTHEMLSNQNSIQLEPGYSPNAGLSNNNYRDHGTAVVSILGSVKDNIGLSGAAYSASEIKGYMEWTTVGYNRASAVSRSINASQAGDIILYEMQTGGKDGQYCPAEYDSVIWDLTKAATDSGIIIIAAAGNGNQNLDDPFYAAYRARGNSGAIIVGAGSPNTTHSKLSFSTYGNRVDVQGWGSNVLAAGYGSYQKYDNDNNRTYNYFSGTSSATPVVASAATLIQSYYYQTTGQYLTPAAMKNLLISTGIPQGGTVVNQKIGPLPNVKNAILQLESSLAAKTKVPLPLEIKIYPNPATSYIAIQSNESKKLDFEIINMQGRTVTKGSVSPDEKINTSNLPTGQYIINITEGQRRVVEKFTKL

SEQ ID NO: 738 - protein, 554 aa, custom Sp.
MRTKIRLFTLLLFSFFLSFGQNPSDKTDQQNSNIYVCFSKNITSEKAALSKNPELAEFVKTNDISFVNDLGFSDRKLDEMIKNSRANGNSGESVEKLKRIFKVNLPLQNNEEAEKLARTLEKFPEVEYVSVMSSTPIEPPFVKAFVATPDLESLQTYLNDNPGINAKYAWSRGITGQNIRIRDVEYGFYKTHEMLSNQNSIQLEPGYSPNAGLSNNNYRDHGTAVVSILGSVKDNIGLSGAAYSASEIKGYMEWTTVGYNRASAVSRSINASQAGDIILYEMQTGGKDGQYCPAEYDSVIWDLTKAATDSGIIIIAAAGNGNQNLDDPFYASYRARGNSGAIIVGAGSPNTTHSKLSFSTYGNRVDVQGWGSNVLAAGYGSYQKYDNDNNRTYNYFSGTSSATPVVASAATLIQSYYYQTTGQYLTPAAMKNLLISTGIPQGGTVVNQKIGPLPNVKNAILQLESTLLLKTKKTETPLPLEIKIYPNPSTSYIAIQSKESKKLDFEIINMQGRTVRKGSVSPDEKINTSDLPPGQYIINITEGQRRVVEKFTKL

SEQ ID NO: 739 - protein, 551 aa, custom Sp.
MKTKIKLFSLFMFSCSLCLAQKPSNGDSYAKANIYVCFSKGIASAKAAFAQNPELEKLARENSMSFTYDLGFTDEKLSEMARNSKLNGYSPESVEKLKRIFKADLPLQNEEYAQRLAQALERFPEVEYASVMSSTPVEPPLINAFVATPDLENLQTYLNDNPGINAKYAWSRGITGQNIRIRDVEYGFYKTHEMLVNQNSIQLEPGYSPNSGLSNNNYRDHGTAVVSILGSVKDNIGLTGAVYNASEIKGYMEWTTVGYNRAAAVSRSINASQAGDIILYEMQTGGKDGQYCPAEYDKVIWDLTKAATDSGIIIIAAAGNGNQNLDDPFYASYMSRGNSGAIIVGAGSPNTTHSKLSFSTYGNRVDVQGWGSSVLAAGYGSYAKYDNDNNRTYNYFSGTSSATPTVASAAVLIQSYYRQTTGQYLSPAAMKNLLISTGIPQGGTVANQKIGPLPNVKNAILQLEGKSATAVKALPSLEVKIYPNPSQNVITLQNVENKKLDFEIISMQGRSVIRGTAMPEEKIDLSSLLPGQYIITISEGQRRVVEKLIKQ

SEQ ID NO: 740 - protein, 551 aa, custom Sp.
MKTKIKLLTLLVFCFFLSFGQSPSDRSAKQNDLIYVCFSKNISSDKDALSKNPELERFARENGISFTYDLGFSSEKINEMMANSRRNGNSGESVLKLKRIFKANVPVQNGDTFQRLVQSLEKFPEIEYVSVMSSTPIEPPLVNMFVATPDLESIQTYLNDNPGINAKYAWSRGISGQNIRIRDVEYGFYKTHEMLTNQNSIQLEPGYSPNSGLANNNYRDHGTAVVSILGSIKDNIGLTGAVYSASEIKGYMEWTTVGYNRATAVSRSINASQSGDIILYEMQTGGKDGQYCPAEYDSVIWDLTKAATDSGIIIIAAAGNGNQDLDDPFYAQYRARGNSGAIIVGAGTPNTTHSKQSFSTYGSRVDVQGWGSSVLAAGYGSYAKYDNDNNRTYNYFSGTSSATPTVASAAVLIQSFYRQTTGQNLSPAAMRNLLVSTGIPQGGTDVNKKIGPLPNVRNAILQLESKSTVSAKALPALEVKIYPNPSSNYIAIQNTEDKKMDIEIINMNGRSVIKSTVSSGEKINISELPVGQYLININERSRRVVEKFTKL

SEQ ID NO: 741 - protein, 682 aa, custom Sp.
MVTFFIKMKTKINLFAVLFAFCSIYSLSFGQDSLPTNPPGELLSNDVLLGYPSIGLKNQQPKMANDQNSIIYVCFSLEAENGKGINSEKTALGNYTFSRITEFDLLFDIDSIIEEVLKDFGKDAEYPFLPPKRNADLERFSRLNAAGNKGENHISFKYDLDFTDSKLDEMAREKFDSLPVFLAIKNKLGIKPVFDKKNSKAIGNSGEFSVEKLKRIYKADLPLQNKETTEKIIHTLERFPEIEYVSVMSAEPILEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDYDPPFYATYLARGNSGAIIVGAGSPNTTHSKLSFSTYGNRVDLVQGWGSSTVLAAGYGSYAKYDNDNNRTYNYCFSGTSSATPVVSSAAILIQSFYRQTTGQYLTPSAMKNLLISTGIPQGGTVTGQKIGPLPNVKNAILQLQESKFATPVKKTETLSALEVKIYPNPSSSSIAIQSSEGVNKKLDIEIINLQGRTVIKSSVLPNNEKIDISQLPTGQYIININEGQRRVVEKLTKLVK

SEQ ID NO: 742 - protein, 550 aa, Chryseobacterium Sp.
MRTKIRLFTLCIFIFVFSFGQKTDQLSSNIYVCFSKDVSSDKEALSKNPALAEFVKTNDISFVNDLGFSERKLEEMMASSRANGNSGESVQKLKRIFRVSLPFLNHEEAERTARTLEKFPEVEYVSVMSSTPIEPPFVKAFVTTPDLESLQTYLNDNPGINAKYAWSRGITGQNIRIRDVEYGFYKTHEMLSNQNSIQLEPGYSPNSGLSGNNYRDHGTAVVSILGSVKDNIGLSGAAYSASEIKGYMEWTTVGYNRATAVSRSINASQAGDIILYEMQTGGKDGQYCPAEYDSVIWDLTKAATDSGIIIIAAAGNGNQNLDDPFYASYMARGNSGAIIVGAGSSNTTHSKLSFSTYGKRVDVQGWGSNVLAAGYGSYQKYDNDNNRTYNYFSGTSSATPVVASAATLIQSFYRQTTGQYLTPAAMKNLLISTGIPQGGTVANQKIGPFPNVKNAILQLESSSLLKSNKAEVPLPLEVKIYPNPVTSHITIHSSDSKKLDFEIINMQGRTVRKGSALPDEKIGTADLLPGQYIINITEGQRRVVEKFTKL

SEQ ID NO: 743 - protein, 575 aa, unknown
  environmental sample
MICFHFIIIFDIIQTYSQPFNKNNMKTKIKFFTLFVFCFFLSFAQSPSDRSAPQNDLIYVCFAKGISSEKDALSKNPKLERFVKENRISFTYDLGFSNEKINEMIASSRLNGNSEESVQKLKRIFKADIPVQNGDAFQRLTQILEKFPEIEYVSVMSSTPVEPPLVNMFVATPDLENLQTYLNDNPGINAKYAWSRGITGQNIRIRDVEYGFYKTHEMLTNQNSIQLEPGYSPNSGLANNNYRDHGTAVVSILGSIKDNIGLTGAVYNASEIKGYMEWTTVGYNRASAVSRSINASQAGDIILYEMQTGGKDGQYCPAEYDSVIWDLTKAATDSGIIIIAAAGNGNQDLDEPFYATYRARGNSGAIIVGAGTPNTTHSKQSFSTYGSRVDVQGWGSSVLAAGYGSYAKYDNDNNRTYNYFSGTSSATPTVASAAVLIQSFYRQTTGQNLSPAAMRNLLVSTGIPQGGTDVNKKIGPLPNVRNAILQLEGKSTASAKALPALEVKIYPNPSSGYIAIQASEDKKLDIEIINMYGRSVIKSTVASDERINISNLPTGQYIVNINEGTRRVVEKFTKL

SEQ ID NO: 744 - protein, 557 aa, custom Sp.
MKKKIFLFLLLFCFFLSFGQNRKGQFQLRGNSQNHNLYVCFSKNINSEKDAIGYSKNPEFKEFVRENDISFVYDLGFSDKKLNEMLANSRLNKNSGESVEKLRRIFKVESPVQNNEDILKLAQALEKFPEIEYASLLSNTPIEPPLTNAFVATPDLEALQTYLFDNPGINVKYAWSRGITGQNIRVRDVEYGFYKTHEMLADQNSIQLEPGYSPNAGLSNNNWLDHGTAVVSILGSGKDNIGLSGAAYNASEIKGFLEWTTVGYNRVSAVSRAINASQAGDIVLYEMQTGGKNGQYVPAEYDNLIWDLTKAATDSGIIIIAAAGNGNENLDDPFYASYRARGNSGAIIVGAGSPNTTHSKLSFSTYGSRVDVQGWGQNVLAAGYGSYAKYDGDNNRTYTYFSGTSSATPIVASAAILIQSYYRQTTGQYLTPAAMKNLLISTGIPQGGTLVNKIGPLPNVKAAIEQLEKTLTLSTKNKTLPPLKVKIYPNPATNYIAIQSPENKKLDFEIINMAGRSVLKGSVSSDEKINISDLPKGQYIINITDGQRRVVEKFIKL

SEQ ID NO: 745 - protein, 506 aa, custom Sp.
MKTKINLFAVLFAFCSSLSFGQDSPTNPPGELLSNDVLLPSIGLKNQQPKMANDQNSIIYVCFSLEAENGKGINSEKTALGNYTFSRNADLERFSRLNAAGNKGENHISFKYDLDFTDSKLDEMARGIKPVFDKKNSKAIGNSGEFSVEKLRIYKADPLQNKETTEKIIHTLERFPEIEYVSVMSAEPILEPPLVNAFVATPDLESLQTYLNDNPGINAKYAWSRGITGQNIRVRDVEYGFYKTHEMLSNQNIQLEPGYSPNNYRDHGTAVVSILGSIKDNIGLTGAAYSTTTVGYNRASVSRSINASQAGDIILYEMQTGGDGQYCPAEYDKVIWDLTKAATDSGIIIIAAAGNGNQNLDYPPFYATYGNSGAIIVGAGSPNTTHKLSFSTYGNRVDLVQGWGSSTVLAAGYGSYAKYDNNNRTYNYCFSGTSSATPVVSSAAILIQSFYRQTGQYLTPSAMKNLLISTGIPQGGTQKIGPLPNVKNAILQLESKFATPVKKTET

SEQ ID NO: 746 - protein, 551 aa, custom Sp.
MKTKIQIFSLFMFSCSLCLAQKPSNGDSYAKANIYVCFSKGIASAKAAFAQNPELEKLARENSMSFTYDLGFTDEKLSEMARNSKLNGYSPESVEKLKRIFKADLPVQNEEYAQRLAQALERFPEVEYASVMSSTPVEPPLINAFVATPDLENLQTYLNDNPGINAKYAWSRGITGQNIRIRDVEYGFYKTHEMLANQNSIQLEPGYSPNSGLSNNNYRDHGTAVVSILGSVKDNIGLTGAVYNASEIKGYMEWTTVGYNRAAAVSRSINASQAGDIILYEMQTGGKDGQYCPAEYDKVIWDLTKAATDSGIIIIAAAGNGNQNLDDPFYASYMSRGNSGAIIVGAGSPNTTHSKLSFSTYGNRVDVQGWGSSVLAAGYGSYAKYDNDNNRTYNYFSGTSSATPTVASAAVLIQSYYRQTTGQYLSPAAMKNLLISTGIPQGGTVANQKIGPLPNVKNAILQLEGKSAKAVKALPSLEVKIYPNPSQNVITLQNVENKKLDFEIISMQGRSVIRGTAMPEEKIDLSSLLPGQYIITISEGQRRVVEKLIKQ

SEQ ID NO: 747 - protein, 552 aa, custom Sp.
MKTKIKLFALFIFCSSLSFGQNPSNQLNRDQNSNIYVCFSKGINSEKAAFSKNPELEKFARENKISFTYDLGFTDEKLDEMARNSKANGNSGESVEKLKRIFKADLPLQNEETAQKLAQTLERFPEIEYVSVMSSTPIEPPLVNAFVATPDLESLQTYLNDNPGINAKYAWSRGITGQNIRIRDVEYGFYKTHEMLANQNSIQLEPGYSPNSGLSNNNYRDHGTAVVSILGSVKDNIGLTGAAYSASEIKGYMEWTTVGYNRASAVSRSINASQAGDIILYEMQTGGKDGQYCPAEYDKVIWDLTKAATDSGIIIIAAAGNGNQNLDDPFYASYMARGNSGAIIVGAGSPNTTHSKLSFSTYGNRVDVQGWGSSVLAAGYGSYAKYDNDNNRTYNYFSGTSSATPTVASAAILIQSYYRQTTGQYLSPAAMKNLLISTGIPQGGTVTNQKIGPLPNVKNAILQLESKSATSTKALPPLEVKIYPNPSTNYIAIQSNENKKLDFEIINMQGRSVIKSSVSSDEKIDISNLPTGQYIININEGQRRVVEKFTKL

SEQ ID NO: 748 - protein, 552 aa, custom Sp.
MKTKIKLFALFIFCFFLSFGQNPSNQLDRSQNSNIYVCFSKGINSEKAAFSKNPELEKFVKENKISFTYDLGFSDKKLDEMAKNSRANGNSGESVEKLKRIFKADVPVQNGETAQKLAQTLEKFPEIEYVSVMSSTPIEPPLVNAFVATPDLESLQTYLNDNPGINAKYAWSRGITGQNIRIRDVEYGFYKTHEMLANQNSIQLEPGYSPNSGLSNNNYRDHGTAVVSILGSVKDNIGLSGAAYSASEIKGYMEWTTVGYNRASAVSRSINASQAGDIILYEMQTGGKDGQYCPAEYDSVIWDLTKAATDSGIIIIAAAGNGNQNLDDPFYASYRARGNSGAIIVGAGSPNTTHSKLSFSTYGNRVDVQGWGSNVLAAGYGSYAKYDNDNNRTYNYFSGTSSATPVVASAAILIQSYYRQTTGQYLSPAAMKNLLISTGIPQGGTVVNQKIGPLPNVKNAILQLESSLAASTKALPPLEIKIYPNPATNYIAIQSNENKKLDFEIINMQGRSVIKSSVSSDEKINISNLPTGQYIININEGQRRVVEKFTKL

SEQ ID NO: 749 - protein, 551 aa, custom Sp.
MKTKIKLLALFIFSFSLSFGQNPSDRSNHQNSNIYVCFSKGINSEKAAFSKNPELEEFVKENGISFTYDLGFSDEKLDEMAKNSKANGNSGESVEKLKRIFKADVPVQNNETAQKLAQTLERFPEIEYVSVMSSEPIEPPLVNTFVTTPNLESLQTYLNDNPGINAKYAWSRGITGQNIRIRDVEYGFYKTHEMLANQNSIQLEPGYSPNSGLSNNNYRDHGTAVVSILGSVKDNIGLSGAAYSASEIKGYMEWTTVGYNRASAVSRSINASQAGDIILYEMQTGGKDGQYCPAEYDSVIWDLTKAATDSGIIIIAAAGNGNQNLDDPFYASYNARGNSGAIIVGAGSPNTTHSKLSFSTYGNRVDVQGWGSNVLAAGYGSYQKYDNDNNRTYTYFSGTSSATPVVASAATLIQSYYRQTTGQYLSPAAMKNLLISTGIPQGGTVVNQKIGPLPNVKNAILQLESSLTLSAKTLLPLEIKIYPNPSTSYIAIQSSENKKLDFEIINMQGRTVIKGSVSPDEKINISNLPQGQYIININDGQRRVVEKFTKL

SEQ ID NO: 750 - protein, 551 aa, custom Sp.
MKTKIKFLILFVFCFFLSFAQSPSDRSVPQNDLIYVCFAKGISSEKDALSKNPELERFVKENRISFTYDLGFSNEKINEMIASSRLNGNSGESVQKLKRIFKADVPVQNADTFQRLTQALEKFPEIEYVSVMSSTPVEPPLVNMFVATPDLENLQMYLNDNPGINAKYAWSRGITGQNIRIRDVEYGFYKTHEMLANQNSIQLEPGYSPNSGLANNNYRDHGTAVVSILGSIKDNIGLTGAVYNASEIKGYMEWTTVGYNRASAVSRSINASQAGDIILYEMQTGGKDGQYCPAEYDSVIWDLTKAATDSGIIIIAAAGNGNQDLDEPFYAMYRSRGNSGAIIVGAGTPNTTHSKQSFSTYGSRVDVQGWGSSVLAAGYGSYAKYDNDNNRTYNYFSGTSSATPTVASAAVLIQAFYRQTTGQNLSPAAMRNLLVSTGIPQGGTDVNKKIGPLPNVRNAILQLEGKSTASAKALPALEVKIYPNPSSGYIAIQASEDKKLDIEIINMYGRSVIKSMVASGERINISNLPTGQYIININEGTRRVVEKFTKL

SEQ ID NO: 751 - protein, 552 aa, custom Sp.
MKTKTTLFALFAFCSTLSFGQDSQSKMADDQNSIIYVCFSKGINSEKTAFSRNADLERFSRENHITFKYDLDFTDSKLDEMVRSSKAIGNSGESVEKLKRIYKADVPLQNKEASEKIIHALERFPEIEYVSVMSAEPIEPPLVNAFVATPDLEGLQTYLNDNPGINAKYAWSRGITGQNIRVRDVEYGFYKTHEMLSNQNSIQLESGYSPNAGLANNNYRDHGTAVVSILGSVKDNTGLTGAAYSASEIKGYMEWTTVGYNRASAVSRSINASQAGDIILYEMQTGGKDGQYCPAEYDKVIWDLTKAATDSGIIIIAAAGNGNQNLDDPFYAAYLARGNSGAIIVGAGSPNTTHSKLSFSTFGSRVDVQGWGSSVMAAGYGSYAKYDNDNNRTYNYFSGTSSATPVVSSAAILIQSFYRQTTGQYLTPSAMKNLLISTGIPQGGTVTGQKIGPLPNVKNAILKLESKFAAPVKTLSALEVKIYPNPSSSSIALKSSENKKLDVEIINLQGRTVIKNSVLPNEKIDISQLPAGQYIININEGQRRVVEKLTKL

SEQ ID NO: 752 - protein, 616 aa, custom Sp.
MKTKINLFAVLFAFCSSLSFGQDSPTNPPGELLSNDVLLPSIGLKNQQPKMANDQNSIIYVCFSLEAENGKGINSEKTALGNYTFSRNADLERFSRLNAAGNKGENHISFKYDLDFTDSKLDEMARGIKPVFDKKNSKAIGNSGEFSVEKLRIYKADPLQNKETTEKIIHTLERFPEIEYVSVMSAEPILEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDYPPFYATYLARGNSGAIIVGAGSPNTTHSKLSFSTYGNRVDLVQGWGSSTVLAAGYGSYAKYDNDNNRTYNYCFSGTSSATPVVSSAAILIQSFYRQTTGQYLTPSAMKNLLISTGIPQGGTVTGQKIGPLPNVKNAILQLESKFATPVKKTETLSALEVKIYPNPSSSSIAIQSSEGVNKKLDIEIINLQGRTVIKSSVLPNNEKIDISQLPTGQYIININEGQRRVVEKLTKLVK

SEQ ID NO: 753 - protein, 552 aa, custom Sp.
MKTKINLFALFAFCSSLSFGQESQPRLNQDQNSIIYVCFSKGINSEKTAFSRNADLERFSRENNISFKYDLDFTDGKLDEMARSSKAIGNSSESVEKLKRIYKADLPLQNEETTQKIIHSLERFPEIEYVSVMSAAPIEPPLVNAFVATPDLESIQTYLNDNPGINAKYAWSRGITGQNIRVRDVEYGFYKTHEMLTNQNSIQLEPGYSPNAGLANNNYRDHGTAVVSILGSIKDNIGLTGAAYSTSEIKGYMEWTTVGYNRASAVSRSINASQSGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTLSPLEVKIYPNPSSSTIAIQSTENKKLDFEIINLQGRTVIKSSVLSNEKIDISQLPTGQYIININEGQRRVVEKFTKL

SEQ ID NO: 754 - protein, 552 aa, custom Sp.
MKTKINFFALFAFCSSLSFGQDIQTKMANDQNSVIYVCFSKGINSEKTAFSRNADLERFSRENKISFKYDLDFTDNKLDEMARSSKAIGNSSESVEKLKRIYKADLPLQNEETTQKIIHSLERFPEIEYVSVMSAAPIEPPLVNAFVATPDLESIQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFAIPVKTLSPLEVKIYPNPSSSTIAIQSAENKKLNFEIINLQGRTVIKSSVLSNEKIDISQLPTGQYIININEGQRRVVEKFTKL

SEQ ID NO: 755 - protein, 552 aa, custom Sp.
MKTKIMLFALFIFCFFLSFGQNRKGQQLQSNSHSLYVSFSKNVNAEADIISKNPEFKKFVEENRISFVNDLGFSDKKLNEMKENSRKNRNSGESVEKLKRIFKVETAVQNNEDILKLAESLEKFPEIEYASLMSNTPIEPPSTNAFVTTPNLESSQTYLNDNPGINVNYAWSRGITGQNIRIRDVEYGFHKTHEMLVNRNTIQLEPGVTPNSALTNNNYLDHGTAVVSILGSAKDNIGLSGSAYNATEMKGFLEWTTTGYNRVAAVTRSINASQAGDIILYEMQTGGQNGNYVPAEYDNVIWDLTKAATDSGIIIIAAAGNGNENLDSSFYASYNARGNSGAIIVGAGSNNTAHSKLSFSTYGSRVDVQGWGQNVLAAGYGSYATYDGDTNRTYTYFSGTSSATPIVASAAILIQSYYRQATGQYLSPAAMKNLLINTGIPQGGNVATQKIGPLPNIKAAIEQLENSLTASTRTLTPLKIKIYPNPATNYISIRSSENKNIDFEIINMAGQSVLKSSVSSDEKINISNLPKGTYIINVTDGQRRVVEKFIKQ

SEQ ID NO: 756 - protein, 552 aa, custom Sp.
MKTKINLFALFAFCSSLSFGQDSQPKMANDQNSIIYVCFSKGINSEKTAFSRNADLERFSRENHISFKYDLDFTDSKLDEMARSSKAIGNSGESVEKLKRIYKADLPLQNKETTEKIIHTLERFPEIEYVSVMSAEPIEPPLVNAFVATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSALEVKIYPNPSSSSIAIQSNENKKLDIEIINLQGRTVIKSSVLPDEKIDISQLPTGQYIININEGQRRVVEKLTKL

SEQ ID NO: 757 - protein, 552 aa, Chryseobacterium Sp.
MKTKINLFALFAFCASLSFGQDSQHRMANDQNSIMYVCFSKGINSEKTAFSRNADLEKFSRENHISFRYDLDFTDSKLDEMARNSKAIGNSTESVEKLKRIYKADLPLQNTETTEKIIRTLERFPEIEYVSVMSADPVEPPLVNAFVATPDLESLQTYLNDNPGINAKYAWSRGITGQNIRVRDVEYGFYKTHEMLSNQNAIQLEPGYSPNAGLANNNYRDHGTAVVSILGSVKDNIGLTGAAYNTSEIKGYMEWTTVGYNRASAVSRSINASQAGDIILYEMQTGGKDGQYCPAEYDQVIWDLTKAATDSGIIVIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPTAMKNLLISTGIPQGGTVTGQKIGPLPNVKNAILQLESKFATPVKTLAALEVKIYPNPSSSSIAIQSNENKKLDIEIINFQGRTVIKSSVLPDEKIDISQLPTGQYIININEGQRRVVEKLTKI

SEQ ID NO: 758 - protein, 550 aa, custom Sp.
MKTKINLLALLLSCSLSFGQHSSDRGTHLNSNIYVCFSKGITSEKVAFDKNPDLEKFITENKISFTYDLGFSDTKLDEMAKNSRMNGFSGESVEKLKRIFKADVPVQNGETAKKLIQILERFPEIEYVSVMSSEPIEPPLVNTFVTTPNLESLQTYLTDNPGINATYAWSRGITGQNIRIRDVEYGFYKTHEMLANQNAIQLEPGYSPNSGLSNNNYRDHGTAVVSILGSVKDNIGLSGAAYSASEIKGYMEWTTVGYNRASAVSRSINASQAGDIILYEMQTGGKDNQYCPAEYDSVIWDLTKAATDSGIIIIAAAGNGNQNLDDPFYAAYNARGNSGAIIVGAGSPNTTHSKLSFSTYGNRVDVQGWGSNVLAAGYGSYQKYDNDNNRTYTYFNGTSSATPVVASAATLIQSYYYQNTGQYLSPSAMKNLLISTGIPQGGTVVNQKIGPLPNVKNAILQLESTLRGTIKSQLPLEIKIYPNPTTSYIAVQSKENKKLDFEIINMNGRTVNKGSIIPDEKINVSQLPQGQYIINFNDGQRRAIEKFSKL

SEQ ID NO: 759 - protein, 696 aa, custom Sp.
MVTFFIKMKTKINLFAVLFAFCSIYSLSFGQDSLPTNPPGELLSNDVLLGYPSIGLKNQQPKMANDQNSIIYVCFSLEAENGKGINSEKTALGNYTFSRITEFDLLFDIDSIIEEVLKDFGKDAEYPFLPPKRNADLERFSRLNAAGNKGENHISFKYDLDFTDSKLDEMAREKFDSLPVFLAIKNKLGIKPVFDKKNSKAIGNSGEFSVEKLKRIYKADLPLQNKETTEKIIHTLERFPEIEYVSVMSAEPILEPPLVNAFPQQLENIKSVDDVTDATPDLESLQTYLNDNPGINAKYAWSRGITGQNIRVRDVEYGFYKTHEMLSNQNSIQLEPGYSPNAGLANNNYRDHGTAVVSILGSIKDNIGLTGAAYSTSEIKGYMEWTTVGYNRASAVSRSINASQAGDIILYEMQTGGKDGQYCPAEYDKVIWDLTKAATDSGIIIIAAAGNGNQNLDYDPPFYATYLARGNSGAIIVGAGSPNTTHSKLSFSTYGNRVDLVQGWGSSTVLAAGYGSYAKYDNDNNRTYNYCFSGTSSATPVVSSAAILIQSFYRQTTGQYLTPSAMKNLLISTGIPQGGTVTGQKIGPLPNVKNAILQLQESKFATPVKKTETLSALEVKIYPNPSSSSIAIQSSEGVNKKLDIEIINLQGRTVIKSSVLPNNEKIDISQLPTGQYIININEGQRRVVEKLTKLVK

SEQ ID NO: 760 - protein, 724 aa, custom Sp.
MAPLSSKLKPTFSNRLALAATIGSIAIMPAIPSYAQILSTDNLPTLGLGSDAFQFDPLPSSDGTERFLAKYGQNAANLTSEENKTKNLSEMAQDYARQKAADVATDEISHWLSKAGNARLNINLDKQLSIKNTQLDWLIPWYDQPDLLLFSQHSIHRTDGRLQTNHGIGLRHFNQNSMMGLNTFFDHDLSYHHSRLGFGLEYAQDYAKISANSYLRLSSWRSTSELKDDYDARPANGWDIQVEGWLPTYSNLGANLKLEQYYGDDVALFGKNKRQKNPMATTVGVHWTPFPLLGINAEHKIGNGNTNETRVNLGLTWLLGKNLAQHLDASAVDATHRISSNRHDFVNRNNNIILEYQNKNLILLSLPQVIQGVTGEEVSIIRNLISEYPLEKIIVEAPELVAAGGSITLNGLKSSVKLPSYKIAENDVKNQQLNRYRLTVTAYDIKGNMSPQAETLVEVSNTGLLAIIHKNGTKKSNVIANGRDPNVFTVVIKDALGHTVPNAKVNFTLPAGLTSFNQKNTSYYSLFNHFMWKAQVAKSASEQEFAIIANSKGEASIQFTASVSGSYALKASTQYGAEINEQFNFKPDIDQSFIGSIEIMQNNALADGNSKNKIKFHIVNNSRQSIAGAQVHFSGKNVAISPTIPTDEQGNTELEISSLTAGTTEIIATLNGDSRVIPVNFIDKNATYHSQENRIVYKGALFRQPTHKPAPQTDSLWHLFGQLF

SEQ ID NO: 761 - protein, 722 aa, custom Sp.
MAPLSSKLKPTFSNRLALAAAIGSIAIMPAIPSYAQILSTDNLPTLGSDAFQFDPLPSSDGTERFLAKYGQNAANLTSEENKTKNLSEMAQDYAHQKAADVATDEISHWLSKAGNARLNINLDKQLSIKNTQLDWLIPWYDQPDLLLFSQHSIHRTDGRLQTNHGIGLRHFNQNSMMGLNTFFDHDLSYHHSRLGFGLEYAQDYAKISANSYLRLSSWRSTSELKDDYDARPANGWDIQVEGWLPTYSNLGANLKLEQYYGDDVALFGKNKRQKNPMATTVGVHWTPFPLLGINAEHKIGNGNTNETRVNLGLTWLLGKNLAQHLDASAVDATHRISSNRHDFVNRNNNIILEYQNKNLILLSLPQVIQGVTGEEVSIIRNLISEYPLEKIIVEAPELVAAGGSITLNGLKSSVKLPSYKIAENDVKNQQLNQYRLTVTAYDIKGNMSPQAETLVEVSNTGLLAIIHKNGTKKSNVIANGRDPNVFTVVIKDSLGHTVPNAKVNFTLPAGLTSFNQKNTSYYSLFNHFMWKAQVAKSASEQEFAIIANSKGEASIQFTASVSGSYALKASTQYGAEINEQFNFKPDIDQSFIGSIEIMQNNALADGNSKNKIKFHIVNNSRQSIAGAQVYFSGKNVAISPTIPTDEQGNTELEISSLTAGTTEIIATLNGDSRVIPVNFIDKNATYHSQENRIVYKGALFRQPTHKPATQTDSLWHLFGQLF

SEQ ID NO: 762 - protein, 1257 aa, unknown
  environmental sample
MSRLKLSQHQDCSINGDNDELHSNNLYISRISYIHKVMTLLSLILLSLFLNSAQAAINSGLSGDDRYAGRFPIGFEFQFYDKTYSRFYVSTNGLIQFSNPSIDYNNTCLPTALNNTLYVFWDDLRTNVENQPIGKIEYQTLGKAPNRRLVVQWTNQYYFGTNLPMGSFQAILYEGTNQIKYQYRNLLDERSHGASATIGIQGPSGQFAEYGCNTADMLTSGQAITFTPNDDGSIYAIDQQAEYDFNDISGLTLDYPAPLLAYTNHAPGWEWHKNKDLNTYQISIQNGAGQTVFESVVGNVDQYSYQAGDIHGETYRAKVRGSINNGATWEMWSGLSSTVTIDKVEPSVILNEFYRLSAKSAVISYEANDDLSGIKSIHVQIAADAAFEQIVMETTLPTNRAQYVLENLPDATSLYARIFAKDKAGNHSIYSTTLELLIAAPTLITPVNGTQVDEPFITVTGITYPNANVQLFLNGVKLDNSVQTDDNGNFTTVISLNNEQIYRLSARVQTTTATSPASYEVQFSYKETGATVLFASPPSDVILTAPTEINVIASDKSGIAQVELYADNTLLETMTQAPYSFMWSLTESDNGQHTLKAIATNGKGKSFEAITNLTVQVLPPAIPLTPYTGKIDSVTPSISYGQPIIIEGHAIDRETTQVMANRPLHIVLMNNGFKRTIAVSSDDNGLFSYSFIPQSTDNGTYSVTVIHPKEQETVAQGEFTIKRVKFHLDGYQLTAAHNVAAKIEIKATSDFDVNGLYWTIRAEDQPAQQLPQGIHISSTPTDIGAGSTVPTNILFKADISAAETGHLYLVAFANESDNIVRGKFQIKYRLTEAQPALYTKPSFIQTGLTQNNSLTETLTLANRGLTAAQNVHLALHDEQGAPAPSWVFLANEPQINTFNLGDSLALNITAQPDETISDGIYRFNLYIRADNQNAFNVPVIISVIQNGTGGIRFDVADIYTATLDEQGLPILGVADATIKLQNDAVLTEQYTLKTDANGIALADQLPPGIYLYRVSAPKHNDVTGRIRIRPGVINNEHVFLNYELINIEFSVTETTIDDVYDINLDVTFNADVPAPVIILEPHAINLYGMHEGEVKTGELTLTNYGLVRADDIKFKLPQSDERFHYEFFGDIPNQLEPKKRLVIPYKITKLTENTLPNTRSLFRLLPKTTSSDNKNCTDYKNNAQAKYNYTCANGDTSSGSDSSSFYERAGEDCYGAWGEDEEEEENDPEQTPSPMTNGCSKDCEGCCSPGNRAGNTY

SEQ ID NO: 763 - protein, 1282 aa, unknown
  environmental sample
MSRLKLSQCQHRATSGANAGQYCKTAPASGLTTSGYRALTILLFLLCSFFVGLVHAAANTGLSGDDRYAGRFPIGFEFRYYDKTYNRFYASTNGLIQFTNPSVEYNNACLPGELNNTLYVFWDDLRTNVDGQPTGKVEYQTLGEAPNRRLVVQWTNQYYFGTNLPMGTFQAILFEGTNQIKYQYRNLLDERSRGASATVGIQGPEGQFAQFGCDTVNMLTSGQAVTFTPAEDGLSYAVDGQAEYDFIDISGFTVDYPAPLAAYTNQAPGWEWNRNSDLNAYQIDVQNSAGESILQETVGNVGQYIYQAGEIHGQTYRAKVRGSINGGATWEMWSGLSSPVTVDKVKPDAAISEFNRLSADSAAIVYQTTDDLSGVKSIQLQVASDSAFDNVVLETVLPVNRAQFQLEQLPEAAALYARIYAVDRAGNRSDDSATVELLIASPTLITPVNGTRVDEPFITVSGTTYPSADVQLFLDGNPLDASVRADETGYFTTVIALDAEQTYRLSAKAQTTLGTSPHSYEVQFSYREIGATVLFAAPNANAVLTAPTEITVIASDNSGIAKVELYDGLTLLTTLTEAPYSVMWRLAESDNGPHTLKAVVTNGKGKTFEALTDVTVEILPPVAPPTPYTGEVSAIAPAISYGQPIVIKGRAVERASSQPMANAPLNIVLINNGFKRTIAVSSDDNGVFSYSFIPQSIDEGVYQVAAAHPNETDATAQGEFTVSRIKFHIGGYNLTAARQIPATIDVRATPNLNVDGLYWTIRAEDQPDGQLPQGVTINGKPIDIAADSTVTTQVQFTADDSAAETGHLYLVAFANESGDVVRGRLQIKYRLTQARPTLYTSPNFIQTGLAREESLTETVTLANRGLTAAENVRLELADESGAPAPAWVFLTGPSQIGTVNVGDTVTINVVAQPDESVSEGVYNIYLNARADNQPYVYALITIAVVQNGTGGIRFDVADIYTATLDADGQPIPGVAGATIKLQNDTVLTEQYTLKTDTDGIAVADSLPPGIYLYRVSAPKHSDVSGRVRVRPGVINNEHIFLNYDVINIEFSVTETTVKDEYEVQIDATYNTQVPAPVVLFEPMSISLNGMQIGEVKTGQLTLTNYGLVRADNLNVTLPQTDDKYRYEFFGDIPNELAPKTRIVIPYKVTKLRAGSAVRSEFNRTPTPFSPMSARSGGGEECTVYISSYFESHTNECANGDEGSGGSGGSYTEITGPCGEVKPGGWEGLPPGDGGEGNGNGLSPLPDPMPLVPSCDPDCTDGQCCTPSGSRPPNGRLDKVGRG

SEQ ID NO: 764 - protein, 416 aa, Yersinia Sp.
MNNITEYNNTENFVPYNVYATSAFEFDWDSSAILKQAVLKGISFIPYVGDYLSSIIGFFWKDQERDIWQEILGRVQQLIEENVLKAIKGILLGDIAELKGKVASVVAALQDHPGTPEAKSLFMSVSVHLDSVQRKFTTFDHKTNYHILPMYSATALMQIMYWTMGIERKDDIGLNSNEVGQLQRNINLLVTHVEDYIQEIYDTELEIQYNDSAPNTVANNVMYVHGYCRVHGLEYTEIIQSIQKNRSNTQGLYSKILSYSTFFGWPTSQARILALKDEINMPEPFKPKLINGRINQVKSVKGYIRRIGGALRVGGLEITFENGSKYSQGTVTGEFSSIDLNGSVIETMETWGSGAIDEAKFTLSDGRTFTVGQRYSTNYRKFALEGHYISGIFIASDRSELAGQAANICVSYHQKQ

SEQ ID NO: 765 - protein, 416 aa, Yersinia Sp.
MNNITEYSNTAAFVPYNVYATSAFEFDWDSSAILKQAVLKGISFIPYVGDYLSSIIDFFWKDQERDIWQEILGRVQQLIEENVLKAIKGILLGDIAELKGKIASVVAALQDHPGTPEAKSLFMSVSVHLDSVQRKFTTFDHKTNYHILPMYSATALMQIMYWTMGIERKDDIGLNSNEVGQLQRNIDLLVKHVEGYIQGIYDTELEIQYNDSAPNTVANNVMYVHGYCRVHGLEYTEIIQNIQKNGSNTKGLYLKTLSYSTFFGWPTSQARILALKDEINMPEPFKPKLINGRINQIKSVKGFIQRIGGALRVGGLEVTFENGNKYQQGTVTGESSSIDLNGGVIETIETWGNGAIDEAKFTLSDGRILTVGQRYSTNYRKFALEGKYISGIFIASDRSELAGQAANICVSYHQKQ

SEQ ID NO: 766 - protein, 416 aa, Yersinia Sp.
MNNITEYSNTAAIVPYNVYATSAFEFDWDSSAILKQAVLKGISFIPYVGDYLSSIIGFFWKDQERDIWQEILGRVQQLIEENVLKAIKGILLGDIAELKGKIASVVAALQDQPGTPEAKSLFMSVSVHLDSVQRKFTTFDHKTNYHILPMYSATTLMQIMYWTMGIERKDDIGLNSNEVGQLQRNIDLLVKHVESYIQEIYDTELEIQYNDSAPNTVANNVMYVHGYCRVHGLEYTEIIQNIQKNGSNTKGLYLKTLSYSTFFGWPTSQARILALKDEINMPEPFKPKLVNGRINQIKSVKGFIRRIGGALRVGGLEVIFENGNKYQQGTVTGESSSIDLNGGVIETIETWGNGAIDEAKFTLSDGRTLTVGQRYSTNYRKFALDGHYISGIFIASDRSELVGQAANICVSYHQKQ

SEQ ID NO: 767 - protein, 416 aa, Yersinia Sp.
MNNLTEYNNTASLIPYHVYATSAYEFDWDSSAILKQAIIKGISFIPYVGDYLSSIIDFFWKDQERDIWQEILSRVQQLIEENVLKAIQGILLGDIAELKGKIASVISALQDHPGTPEAKSLYMSVSVHLDSVQRKFTTFDHKTNYHILSMYSTTALMQIMYWTMGIERKDEIGLNNNEVGQLQRNIDQLVKHVEDYIQGIYDAELDIQYNDSSPNTVANNVMYAHGYCRVHGLEYTEIIQNVQKNGSNTEGLYLKTLCYSTFFGWPTSQARILALKDEINMPEPFKPSLVNSRINQIKSLKGYIQRIGGALRVGGFEIIFANGNRYQQGTVTGESSSIELNGSLINTLETWGNGAIDEAKFTLSDGRTFTVGQRYSTNYRKFALDGHYISGIFVSSDRKELAGQAANICVSYHQKQ

SEQ ID NO: 768 - protein, 416 aa, Yersinia Sp.
MNKITEYDNIASLTPYPVYASSAYEFDWNSSAILKQAIIKGISFIPYVGDYLSSIIDFFWKDQERDIWQEMMGQLHQLIEESVLKAIQGILLGDIAELKGKIASVVSALQDHPGTPEAKSLYMSVSVNLDSVQRKFTTFDHKTNYHILSMYSTTALMQIMYWTMGIERKDEIGLNNNEVGQLQRNIDQLVKHVEDYTQGIYDTELDIQYNESSPNTVANNVMYAHGYCRVHGMEYTEIIQNVQKNGSNTKGLYLKTLCYFTFFGWPTSQARILALKDEINMPEPFKPSLVNGRINQIKSIKGYIQRIGGALRVGGFEIIFANGNRYQQGTVTGESRSIELNGSLINTLETWGNGAIDEVKFTLSDGRTLSVGQRYSTNYRKFALEGHYISGIFVSSDRKELAGQAANICVSYHQKQ

SEQ ID NO: 769 - protein, 136 aa, Yersinia Sp.
MSKVTITIDSCSNEVEVKNQTEVDTESLALTTAQVRARVPTEVAPNSSTEVLYRSTPIIPESRRNVMITNDGAANVITAQYYWSHSFTSQWFLYTSIDVNVGDSKLLVSPSNSLYYSKVVLINNTNRKAYVTAEEK

SEQ ID NO: 770 - protein, 136 aa, Yersinia Sp.
MSKVTITINTDTNEVDVKNLTEADTENLTLTAAQARARVPTEVAPNSSTEVLYRSTPIIPESRRNVMITNDGAANIITAQYYWSHSFTSQWFLYTSIDVNVGDSKLLVSPSNSLYYSKVVLINNTSRKAYVTAEEK

SEQ ID NO: 771 - protein, 137 aa, Yersinia Sp.
MNKVTITINTESNTVEVENPTEIYKTETAALISAPFRARVAAEVAPNSSTEVFYQSTPIIPESRRNIIITNDGAANLITAEYYWSHSFTSQWFLYTSVEVSVGESKLLQSPSNSLYYSKVVLVNKTSRKAYVTAEEK

SEQ ID NO: 772 - protein, 470 aa, custom Sp.
MKKAKFETSSGRRVFIQRAAAGASVLSTAGLVYANDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHYSSTIDKARRDNPHSTVGLAQNMPLSAMLIEKTKYQLTVLDLRDTWANLDPIRYPGKSRIKLDREIFTPVIGWLGRKNSRPDVIPVWRRPSSPLSSLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLI

SEQ ID NO: 773 - protein, 470 aa, custom Sp.
MKKAKFETSSGRRVFIQRAAAGASVLSTAGLVYANDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHASSTIDKARRDNPHSTVGLAQNMPLSAMLIEKTKYQLTVLDLRDTWANLDPIRYPGKSRIKLDREIFTPVIGWLGRKNSRPDVIPVWRRPSKAITKLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLI

SEQ ID NO: 774 - protein, 470 aa, custom Sp.
MKKAKFETSSGRRVFIQRAAAGASVLSTAGLVYANDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHYSSTIDKARRDNPHSTVGLAQNMPLSAMLIEKTKMTLTVLDLRDTWANLDPIRYPGKSRIYLDREIFTPVIGWLGRKNSRPDVIPVWSPPTKAITKLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLI

SEQ ID NO: 775 - protein, 455 aa, Curtobacterium Sp.
MRPHKHVTLLCASAAVAIGAAALAPSAAFAHGFVGDDSGDPTHTLTARVAMQANGDMGGAQYDPQSLEAPKGFPAAGPADGHLASAGHTEWSVLDEQGEDRWQKNVVEQGDVTVNWTYTAPHKTSQWRYYMTKDGWDPNDALDRDDLELIETVEHDGSEASNNPSHEITIPSDREGYHVIYAVWDVADTANAFYNVIDVDVQPGDGETPEPVEDTEAPGLVPDAAGRAVSSTEAEITWGAASDDRGVARYQVVRLGATEGDFQVVKEVSATGRSARLTGLQPGEVYSFGVRAVDAAGNVGLAHTILTVRMPEQAAAPAAPKHLHDMGTTESTVALMWTAGDDTEGVRYEVFRDGDKVGETGATDFVDVGLRAGSRHEYTVRAVNLDGIASAMSNRHVTTTKGDAASEYPTWDAHAAYTKGDRVTHGGSVYEAVQSYQGHGDPNWITAPSLWKPVS

SEQ ID NO: 776 - protein, 452 aa, Pseudomonas Sp.
MSKHIANPISKNIVPRHGHIFSPASRAYFAWQAGDLDEGALNQRESGKFFPAVAGGLLDVYAPEDVANSPPPPDGKIASANQATGLFLDQPGSHWQKHEVRGGEMLDISWHFTANHVTRRWNYFITKEAWDPSQVLSRDQFEAEPFYTVQINLKPYWSHGDAMKPPSPTVHQMPLPIREGYHVLLAIWEVADTAAAFYQVVDLDFVEREGGGGRPTTPTGLKASDITDKQVRLTWNASTGSSSIASYRITRDGSTTVDVYVPLLSWTDNSVLPGTSYSYFVTAIDDRGNQSLPSTAIQVRTQAEGGGTAPPTAPVNLHSMNTTANTVSLMWGASTGGYPLKHYNFYRDGVQVATIPASQTSYTDSGLTAATMYRFFVAAEDTQGQLSVPSNVLSVTTSTGEGGETPEWKLGESYKVGDKVIYQGVKYACFQAHISNAGWTPAETVNILWLLV

SEQ ID NO: 777 - protein, 455 aa, Pantoea Sp.
MANIISKPKNSISSRHGHIFSPKSRAFFAWEKGQIDDGMLNQREAGKFFPAKVSGLADPVAPTDVHSALPPRDGEIASANQGNARFLDQPGSDWPKHDVISGQLLPVRWYYSAVHVTRRWNYFITRKDWNPDLPLSRAQFDEKPFFSVELTEQPFWSHGDALTPPNPTEHTVMLPERRSYHVLLAVWEVANTGNAFYQVIDLNFTDSTIPLPPPAAPEALRVKGMTCDTISLAWSAPSVAAAYYNIYRDGLLADSVKAVEFTDSGLKEDTEYTYEVTSVAVSGAESARSHTLTVRTQSCAAIDNPPTAPGNLHSMKVTTNSVSLMWSPSQSSVAIKRYILHRDGHVIAHTPACQLTYVDSPLQEDTTYHYYVVAQDANGLLSAPGNQLAVTTEQTSTAPDPDPYRKWALRSTFSAGEIVSHNGRLWQCLQTHVAYSPEWAPGASDSATLWRQVKP

SEQ ID NO: 778 - protein, 651 aa, Arsenophonus Sp.
MNIKKYAENSKIVHINHNFIQDNQSSLIRTFVIEEVNVEFIRLVFTLANMPSGSYIEIIDRKRQHTRIFPLKEGSTLNVTFYTNCIDIKVILPKNYHYSNNQIMELAYYEALPLNLTQIVEDSNDGRQPYMWYKNTPFFNPARAVHFVVFNGYGGTCSFIGSANHVLTNRHVALGPNSQIDPEAIKSSEMWVNKHNIANDFSSPETDTIHFDVDKILTHGESNGGLGDYALFTIADFDYHNAHVKTLFGGLKLQQTLNKKRENIYIPQYGGAKPLQISARLRDSMDPFASINPDVPEGTLLIHGDMEAGSSGSPLVGRETHNILGILWSRFIIFQQGISSPYLLDKLKEFIADSNTQVKAQDNIVSHNIEATPVDDAEIKVIFGDKEQLIPFNTVLVENHDGYSIIEMAGLDLTTKTTLAVKYKVLAIMSNNQATHLNDPALTGEVTLRFIPYQHPQDTVIKSWFVARIERNGEIVNNYIARILSYNYDIFEIPFDVKKADCMPLIFDAKQANTILHPFTETNPNLSFYTLRHGQGAENIGEISDDYSILKTQVINEKGEKELVTFQAYRIKSITESEPYPYISMPSRINVKCNYNIEGPSYLRVCYYPEDNQNLIGKGTFKGIIALHASDESGSAERLCKNILLDITING

SEQ ID NO: 779 - protein, 1261 aa, Yersinia Sp.
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYTNTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPDAGALTGATVNRLSAADIAADPTRVATETGALTLAEGGALSSLGDSVLSGNLISAGGILLSNTYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 780 - protein, 1256 aa, Yersinia Sp.
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYANTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 781 - protein, 1256 aa, Yersinia Sp.
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLFIQNDTSMIGQSTSTNVQANGSIGSGVYINNQSSDDSTIRVDLSGMLSSGLNGTPALAIYSLADNDSTITLNIHAISGIAGIQSDNNSLYGTAITNVDIANDINVEYSGASIRNYSNSGTSILNFNSKSIRTDLDALDINNSSYSGEVMTDINIDGDISSANSQAARIYNYTNGGLSSLRFRANNVTGEYAGLYIDNSSQNGAVTDIILTGDLTATSGSALHANTFSEEGNIETAIKLNNVYSLYNALNINGHNQTGNILLDLDVSGTITSENGTGIKVMGTTFEGNSTILINVNNITSSSQSLDINNYSSSGSALSAITATGHLATEWGQGVTFQTYSSLGDATTLIHVNDITSMGNGIYSLTEASRGTATTDVTVTGQINVSDGEGITLNMQTIDGNTLVNIDVNNIASEYDAIHLYNNNYTTGVDDGTGVDNGTSTIDLITRGALVSQQGYGINIETNTADTYVTVGGLVHGGNGTAIGLHRLENVQTSATLELQSGYALEGVTQALVFTGNYADINDAALDLANSHLVLGGTGDAAFDLGRIDNREEAILDGDPNRITGFGTLTKTNNSIWTLTGSNMADGDANAFLSANIGGGILVLDNATLGLTPATTILNRLSAADIAADPTLVATETGALTLGEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGIRYQAGVPLYEQYPQVLAALNTLPTLQQRVGNRYGAPGALADLNFDDNQWAWGRIEGSHQVTDPARSTSGSQREIDVWKLQTGIDVPLYQSQDGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLNKETTWSAKDGTTRRSHIYSHLDLHNEFLNGSKVQVSGVEFATRDKRQSVGLGAGGTYEWQNGRYAVYGNVNLLGATRNVSDNYAVGGTIGARVSW

SEQ ID NO: 782 - protein, 1266 aa, Yersinia Sp.
MHIQFREPISTSPAQPDAGHQHLFSRVPAAAINPITLAIIVAFSTLTLPQTARATCSSSGVGTYVCEGENNAGISLNGTDIVVETLPGFGITEPGDIDPALSLIGSGAISYLDTNSSALDTAGAYSLSIQNDTSMIGQSTSTNVQANGSIGSGVYIDNQSSDDSTIRVDLSGMLSSGLNGTPALAIYSLADNDSTITLNIHAISGIAGIQSDNNSRYGTAITNVDIANDINVEYSGASIQNYSNSGTSILNFNSKSIRTDLDALDINNSNYSGEVMTDINIDGDISSANSQAVKIYNYTNSGLVSLRFRANNVTGEYAGLYIDNGSSNGAVTDIILTGDLTATSGSALYANTYSDEGNVETAIKLNNVYSLYDALNINGYNQIGNMLLDLDVSGTITSENGTGIKVMGMTFEGNSTMLINVNNITSSSQSLDINNYNSSGSALSAITATGHLVAEWGQGVTFQTYSSQGDATTLIHFNDITSMGNGIYSFTEASRGTATTDITVTGQINSSNGEGITLNTQSIDGNTLVNIDVNNIASEYDAIQFYNNNYITGVDDGTGVDNGTSTIDLITRGALVSQQGYGINIDTNIADTYVTVGGLVHGGGGTAIGIHRLDNIQKSATLELQSGYALEGATQALVFNGNYVDMNDAALDLANSHLVLGGTGAAAFDLGRIDNREEAILDGDPNRITGFGTLSKTNNSIWTLTGSNMADGDANAFLSANIAGGILVLDNATLGLTPVTGALTSAALNRLSAADIAADPTLVATETGALTLGEGGALSSLGDSVLSGNLISAGGILLSNSYTGGNGAATDDRLTVTGTYFGESNGSGEGAWLALDTVLGDDDSATDRLVINGDATGTTSVRVNNAGGLGDKTLNGINLITVDGLAQDDTFLLAGDYVTTDGYQAVVGGAYAYTLQADGEATTAGRNWYLSSELMLTEGVRYQAGVPLYEQYPQVLAALNTLPTLQQRVGNRYGAPGALAALNFDDNQWAWGRIEGSRQVTDPARSTSGAQREIDVWKLQTGIDVPLYQSQGGSLLTGGVNFSYGKAKADINAFFGDGSINSSGYGLGTSLTWYGNNGVYVDGQLQTMWFDSDLSSSTAGHALISGNNGRGYTSAVETGKRYALGNGVSLTPQMQVSYSRVDFDTFRDTFDSEVSLQEGDSLRGRIGVSLDKETAWSAKDGSTRRSHIYSHLDLHNEFLNGSKVQVSGIEFATRDERQSVGLGAGGTYEWQNGRYAIYGNVNLLGATRNVSDNYTVGGTIGARVSW

SEQ ID NO: 783 - protein, 1267 aa, Yersinia Sp.
MHIQFREPISTSPAQPDAGRQHLFSRVPAAVMNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYNSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTADITVTGQINVSHGEGITLNALTTDGRTLVNVDVNNIASEYDAIRLYNYNDNYATGVDDGTGADNGTSTIDLITRGALVSQQGYGINIETNTADTYVTVGGLVHGGNGTAIGIHRLDNIQTSATLELQSGYALEGVTQALVFTGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 784 - protein, 1264 aa, Yersinia Sp.
MHIQFREPISTSPAQPDAGRQHLFSRVPAAVMNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNDNYATGVDDGTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGTGDAAFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 785 - protein, 1285 aa, Yersinia Sp.
MHIQFREPISTSPAQPDAGRQHLFSRVPAAVMNPITLAIIVAFSPLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETSIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNYNYNYNYNYNYNYNYNDNYATGVDDGTGADNGTSTIDLITRGALVSQQGYGINIETNTADTYVTVGGLVHGGNGTAIGIHRLENVQKSATLELQSGYALEGVTQALVFTGSYAEINDAALDLANSHLVLGGAGDAAFDLTRIDNREEAILDGDPNRITGFGTLTKTNNSIWTLTGSNMADGDANAFLSANIAGGILVLDNATLGLTPDAGALTGPTVNRLSAADIAADPTLVATETGALTLGEGGALSSLGDSVLSGNLISAGGILLSNHYTGGNGTATDDRLTVTGTYLGENNGSGEGAWLTLDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 786 - protein, 1297 aa, Yersinia Sp.
MHIQFREPISTSPAQPDAGRQHLFSRVPAAVMNPITLAIIVAFSPLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETSIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNYNYNYNYNYNYNYNYNYNYNYNYNYNYNDNYATGVDDGTGADNGTSTIDLITRGALVSQQGYGINIETNTADTYVTVGGLVHGGNGTAIGIHRLENVQKSATLELQSGYALEGVTQALVFTGSYAEINDAALDLANSHLVLGGAGDAAFDLTRIDNREEAILDGDPNRITGFGTLTKTNNSIWTLTGSNMADGDANAFLSANIAGGILVLDNATLGLTPDAGALTGPTVNRLSAADIAADPTLVATETGALTLGEGGALSSLGDSVLSGNLISAGGILLSNHYTGGNGTATDDRLTVTGTYLGENNGSGEGAWLTLDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 787 - protein, 1259 aa, Yersinia Sp.
MYIQFREPISTSPAQPDAGHRHLFSCAPAAAINPITLAIIVAFSALVLPQTARASCNSSGVGTYVCEGENHAGIILSGTDIAVETQPGFSITEPGGADPALSLIGSGAISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSITYLTVTGQINASNGEGITLSSQATDGSTLVNIDVNNIASEYDAIYLHNSVTGVDNGTSTIDLITRGALVSQQGYGINLETNTADTYVTVGGLVHGGNGTAIGIHRLENVQTSATLELQSGYALEGVTQALVFTGSYAEINDAALDLANSHLVLGGTGDAAFDLTRIDNREEAILDGDPNRITGFGTLTKTNNSIWTLTGSNMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGCGYTSAIEAGKGYTLGHGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 788 - protein, 1254 aa, Yersinia Sp.
MYIQFREPISTSPAQPDAGHRHLFSCAPAAAINPITLAIIVAFSALVLPQTARASCNSSGGGTYVCEGENHAGIILSGTDIAVETQPGFSITEPGGADPALSLIGSGAISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSITYLTVTGQINASNGEGITLSSQATDGSTLVNIDVNNIASEYDAIYLHNSVTGVDNGTSTIDLITRGALVSQQGYGINIETNTADTYVTVGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGSNMADGDANAFLSANIAGGILVLDNATLGLTPATTILNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTRNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDKRQSVGLGAGGTYEWQNGRYAVYGNVNLLGATRNVSDNYAVGGTIGARVSW

SEQ ID NO: 789 - protein, 1259 aa, Yersinia Sp.
MYIQFREPISTSPAQPDAGHRHLFSCAPAAAINPITLAIIVAFSALVLPQTARASCNSSGVGTYVCEGENHAGIILSGTDIAVETQPGFSITEPGGADPALSLIGSGVISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSTTYLTVVGQINASNGEGITLISQATDGSTLVNIDVNNIASEYDAIYLHNSVTGADNGTSTIDLITRGALVSQQGYGINLETNTADTYVTVGGLVHGGNGTAIGIHRLENVQKSATLELQSGYALEGVTQALVFTGSYAEINDAALDLANSHLVLGGAGDAAFDLTRIDNREEAILDGDPNRITGFGTLTKTNNSIWTLTGSNMADGDANAFLSANIAGGILVLDNATLGLTPTAGALTGPAVNRLSAADIAADPTRVATETGALTLGEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGNYVTTDGYQAVVGGAYAYTLQADGEAATEGRNWYLSSELMLTEGVRYQAGVPLYEQYPQVLAALNTLPTLQQRVGNRYGAPGALAELNFDDNQWAWGRIEGSHQVTDPARSTSGSQREIDVWKLQTGIDVPLYQSQDGSLLTGGVNFTYGKAKADIHSFFGDGRINSAGYGLGTSLTWYGNNGVYVDGQLQTMWFDSDLSSRTEGHAVASGNNGRGYTSAIEAGKGYALGNGLSLTPQIQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 790 - protein, 1268 aa, Yersinia Sp.
MLKHFRLGLFTANVQADTGSQHSFSRVPAAAINPITLAIVVAFSTIALPPMALAACTSPGVGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLDFDNNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 791 - protein, 1259 aa, Yersinia Sp.
MHIQFRELISTSPAQPDAGHQHLFSRVPAAAINPITLAIIVAFSTLVLPQTARATCSSSGVGTYVCEGENNAGIILNGTDIAVETRPGFGITEPGGAEPALSLIGSGAISYLDTNRSALDTTGTDSLYIQNDTSMTGQSTSINIQSNSSIGNGININNRSGADATIQIDLSGTLSGNLNGSAALSIHSSAEGNSAFTLNLDALSGSMGLQSYNDSRSGIVTTNINIANDINVEYSGASINNTGNGETSIISFNSKNIRTELDGLNVYNTNYSGAVITDINIDGDISSANSQAATFYNSAYDGPSSFRLRANHITGEYAGLYISNDSRNSSVITDILLTGDITSTSGAGFVFNSYVEGGDSGASIKLNNIYSYYEALSLSANTVNGDMRFDLDISGDIVNEYGTGILMMGGTSEGNSTIIINANNINSGSQSLSVSNYSYLGAAFSDITASGHLLSEHGQGAIINTTSNQGKATTVINLNDITAVGSSIEIYTAANEGDSTTDLTVTGQINSSNGEGITLHALATDGSTLVNVDVNNIASEYDAIYLHNSVTGVDNDTSTIDLTTRGALVSQQGYGINIDTNTADTYVTVGGLVHGGGGTAIGIHRLDNIQKSATLELQSGYALEGATQALVFNGSYADMNDAALDLANSHLVLGGTGAAAFDLGRIDNREEAILDGDSNRITGFGTLTKTNNSIWTLTGSNMADGDANAFLSANIAGGILVLDNATLGLTPVTGALTSAALNRLSAADIAADPTLVATETGALTLGEGGALSSLGDSVLSGNLISAGGILLSNSYTGGNGAATDDRLTVTGTYFGESNGSGEGAWLALDTVLGDDDSATDRLVINGDATGTTSVRVNNAGGLGDKTLNGINLITVDGLAQDDTFLLAGDYVTTDGYQAVVGGAYAYTLQADGEGTTAGRNWYLSSELMLTEGVRYQAGVPLYEQYPQVLAALNTLPTLQQRVGNRYGAPGALAALSFDDNQWAWGRIEGSRQVTDPARSTSGAQREIDVWKLQTGIDVPLYQSQGGSLLTGGVNFSYGKAKADINAFFGDGSINSSGYGLGTSLTWYGNNGVYVDGQLQTMWFDSDLSSSTAGHALISGNNGRGYTSAVETGKRYALGNGVSLTPQMQVSYSRVDFDTFRDTFDSEVSLQEGDSLRGRIGVSLDKETAWSAKDGSTRRSHIYSHLDLHNEFLNGSKVQVSGIEFATRDERQSVGLGAGGTYEWQNGRYAIYGNVNLLGATRNVSDNYTVGGTIGARVSW

SEQ ID NO: 792 - protein, 364 aa, Bacillus Sp.
MIKNGKEICCMPNLEKGIAYNIALGTDPSLVFDILGNSTEFGSIVGLYAKGQNSINQQFFFFELDGGRMAIVPRNSGRPLEPGFGATPDTLIVQGEWTGLSSQQWGLQDKTASSVHIFNQSNGLVVSYGRNDQDQFPELNTPNPSGPAPERAWYLEPAYQAILPNFVPTTSIYSPPQYSSGIYEVLPDQSEVATVSNALIPCILVNDGALSPETKVQQSPYYLLIKQQFWQKAAFGTVSPNSIREFSFKAGTTFEDQKSMSDTINMTVGGDFGLQFNEVSTNAKFGISQQIQTAVSTTNEELSELTETLSYNNIQKDTLVGVSIYQLVTRYVLYRANGSLVAQPWKFIDNASAVTVITEQPIGV

SEQ ID NO: 793 - protein, 820 aa, Brevibacillus Sp.
MKLPKMYKCLLATALLGSFTSYPELSHAASSEKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELKKGKLYKIKITYQPESSSANEFGLQLNWITPQGTEEIIPEGNLLLPDIKNQPENESSRKKRSISTSDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINNDQLTILEQTRQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDEPGVHEGLSSWEIDGEDNYYKYDVLQTGWQTINGKKYYFNENGTLVPNKVIEDGTYQINTALKNTSLVDWNRSDNNITVWETNDGNNQKWKLKYDDSQQAYVIRSVENNDKIMAWNAYQDSTNVFATAFEGKPEHFWIPELLGNDFYILKNKKDPTKVLDVDGSGTSNGSNIQVSDYKGTDNQKWKLEQLEAN

SEQ ID NO: 794 - protein, 820 aa, Brevibacillus Sp.
MKLPKMYKCLLATALLGSFTSYPELSHAASSKKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELKKGKLYKIKITYQPESSSANEFGLQLNWITPQGTEEIIPEGNLVLPDIKNQPENESSRKKRSISASDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINKDQLTILEQTRQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDESGDHEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSVEKNDKIMAWNAYQDSTNVFATAFEGKPEHFWIPELLGNDFYILKNKKDPTKVLDVDGSGTSNGSNIQVLDYKGTDNQKWKLEQVEAN

SEQ ID NO: 795 - protein, 821 aa, Brevibacillus Sp.
MKLPKMYKCLLATALLGSFTSYPELSHAASNENEIINDQEANFKGLLGYYFNDKELKETALISNSESGDLFVDNDQIDDMLPDELKQFQSAMWRGFIKVEKSGEYTFSTSDNDHTMLWIDDQQVIDHSSATQKIKLEKGKLYKINITYQPESSSANEFGLQLNWITPQGTEEIIPEGNLLLPDIKNQPENESSRKKRSISTASDGGVEDSDGDGIPDSLEIEGYTLDVKNKKLTLMPWIEKVHGKKRTKSGAPLTKYTSSPMKWSTASDPYSDFAKVSGMIDKKVKVKHPLIAAYPNLQVHMDKFIISKNRNETLENGVNTSSSISGSTSTSNTHSTEASVGAQVHASLFNFGGSVSTNFSDSNSQTVTIDRSSSESLGKNWSKSLGLNAGEAAYFNANIRYVNNGTAPIYEAAPTTSLVLGKNDTIATIKAKENQLANVVLPDRFYPSKDQAAISLQTKDDFGSSPITINKDQLDILEQTQQMRLETDQVSGYVGVIDPKTKLVEVDKDKQWSHIIPQIEETTARLILKTPDNSELERRVAAVDPDDIIEQTKPDVTLGEALQLAFGFEDKEGKLYYNNTSIDDFRLVFDEETAENIEKQLEDLKTKNIYDVQLHARMNILISPKKDEPGVSEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSLENNDKIMAWNAYQDSTNVFAATFEGKPEHFWIPELLGNDFYILKNKKDPTKVLDVDGSGTSNGSNIQVRDYKGTDNQKWKLEQVEAN

SEQ ID NO: 796 - protein, 820 aa, Brevibacillus Sp.
MKLPKMYKCLMATALLGQIATYPEISHAASNEKEVVTTQDANFKGLLGYYFNDKDLKQTAMISNSETGDLSIDSDQLDEMLPEELQQFQSAMWKGFIKVEKSGEYTFSTSDNDHTTLWIDDQQVIDHSSATQKIELEKGKLYKVKITYQPESSSTDEFGLQLNWITPQGTEEIIPEGNLLLPDIKNQPENESGRKKRSISASDDGVEDSDGDGIPDSLEVEGYTLDVKNKKLILMPWIEKVHGKKRTKSGEPLTKYKSSPLKWSTASDPYSDFAKVSGMIDKKVQVRNPLLAAYPNLQVHMEKFIISKNRNETLENGGNTSSSISGSTSTSNTNSIEASIGSEVNASLFNFGASISTNLSTSNSQTVTIDRSSSESLGRNWSKSLGLNAGEAAYFNANIRYVNNGTAPIYEAAPTTSLVLGDNDTISTIKAKENQLANVVLPDRFYPSKDQAAISLQTKDDFGSSPITINKDQLDKLEQTQQMRLETDQVSGYVGVIDPKTKLVSVDKDKQWSHIIPQIEETTARLILKTDDSETERRVAAVDPDDYTEQTKPDITLGEALQLAFGFEDKEGTLYYNNKSIDEFKLVFDEETAENIEKQLEDMESENIYDVQLHARMNILIKPNNDEPTDEVEVSGWETLDGEEYYYRFGVMQTGWQTIDGKRYYFNENGALVPNRVIEDGTYQIKTALKNTSLVDWNRNDNNITVWETNDGSNQKWKLEYDDSHQAYVIRSLENNDKIMAWNAYQDSTNVFATPFEGKPEHFWIPEWIDNDFYILKNKKDPTKVLDVDGSSTSNGSNIQVSDYKGTDNQKWEVKQVKES

SEQ ID NO: 797 - protein, 820 aa, Brevibacillus Sp.
MKLPNMYKCLMATALLGQFATYPEISHAASHEKEVVTTQDANFKGLIGYYFNDKELKQTALISNSETGDLSIDSDQLDDMLPEELQQFQSAMWKGFIKVEKSGEYTFSTSDNDHTMLWIDDQQVIDHSSATQKIELKKGKLYKVKITYQPESASANEFGLQLNWITPQGREEIIPEGNLLLPDIKNQPENESSRKKRSISASDDGVEDSDGDGIPDSLEVEGYTLDVKNKKLILMPWIEKVHGKKRTKSGAPLTKYKSSPLKWSTASDPYSDFAKVSGMIDKQVQVRNPLLAAYPNLQVHMEKFIISKNRHETLENGGNTSSSISGSTSTSNTNSVEVSVGAEVHASLFNFGGSVSTNLSASNSQTVTIDRSSSESLGKNWSKSLGLNAGEAAYFNANIRYVNSGTAPIYDAAPTTSLVLGDNDTISTIKAKENQLANVVLPNRFYPNKEQAAISLQTKDDFGSSPITINKDQLDKLEQTQQMRLQTNQVSGYVGVIDPKTKLVSVDKEKQWSHIIPQIEETTARLILKTDDSETERRVAAVDPDDYTEQTKPDVTLGEALQLAFGFEDKDGTLYYDNKSIDEFKLVFDEETAENIEKQLEDMESENIYDVQLHARMNILIKPNNDEPIDEVEVSGWEEFDGEKYYNRFGVMQTGWQMIDGKRYYFNENGALVPNRVIEDGTYQIKTALKNTSLVDWNKSDNNITVWEKNNEDNQKWKLEYDDSHQAYVIRSVENNDKIMAWNAYQDSTNVFATAFEGKPEHFWIPEWIDNDFYILKNKKDLTKVLDVDGSNTSDGSNIQVRDYKGTDNQKWEVKLVKES

SEQ ID NO: 798 - protein, 820 aa, Brevibacillus Sp.
MKLPNMYKCLMATALLGQFATYPEISHAASHEKEVVTTQDANFKGLIGYYFNDKELKQTALISNSETGDLSIDSDQLDDMLPEELQQFQSAMWKGFIKVEKSGEYTFSTSDNDHTMLWIDDQQVIDHSSATQKIELEKGKLYKVKITYQPESASDNEFGLQLNWITPQGREEIIPEGNLLLPDIKNQPENESSRKKRSISASDDGVEDSDGDGIPDSLEVEGYTLDVKNKKLILMPWIEKVHGKKRTKSGAPLTKYKSSPLKWSTASDPYSDFAKVSGMIDKQVQVRNPLLAAYPNLQVHMEKFIISKNRHETLENGGNTSSSISGSTSTSNTNSVEVSVGAEVNASLFNFGASISTNLSTSNSQTVTIDRSSSESLGKNWSKSLGLNAGEAAYFNANIRYVNSGTAPIYDAAPTTSLVLGDNDTISTIKAKENQLANVVLPNRFYPNKEQAAISLQTKDDFGSSPITINKDQLDKLEQTQQMRLQTNQVSGYVGVIDPKTKLVSVDKEKQWSHIIPQIEETTARLILKTDDSETERRVAAVDPDDYTEQTKPDVTLGEALQLAFGFEDKDGTLYYDNKSIDEFKLVFDEETAENIEKQLEDMESENIYDVQLHARMNILIKPNNDEPIDEVEVSGWEEFDGEKYYNRFGVMQTGWQMIDGKRYYFNENGALVPNRVLEDGTYQIKTALKNTSLVDWNKSDNNITVWEKNNEDNQKWKLEYDDSHQAYVIRSVENNDKIMAWNAYQDSTNVFATPFEGKPEHFWIPEWIDNDFYILKNKKDLTKVLDVDGSNTSDGSNIQVRDYKGTDNQKWEVKLVKES

SEQ ID NO: 799 - protein, 653 aa, Bacillus Sp.
MFKEKTNRRLKKIVIITAACTMMSMYGAPISSTEAAIRSHAPSVYVTPQNTAASDIISIDWSPVQTAPYTYWAVHNWNQGGEGGGYAGFQQQSGFDQTGKRTLHFALWDPIASNQAIKAEYLSPTSEAGRFGGEGTGLKVQTTYNWKDSEWYRMTLRSWQEDGHTKFGQWIKDNKLNQWKLVAIMDHPVANVAFNYGLSMFQEDWAGNGQDVREARLKNGYSRKVSDQQWNSWNNQRISGQHDTSYQYDGGATSEYLWVKAGGNTQSTIGTGKSFNINQPSQPEMGILDFDIQNIRFEDEKLNVSWKLKEQSTPQFKGKIEIYDNEKLMGQPLKVIDNIKSYETEISQTMQLPQTAFAKITLTDIFDRTVEKKVGIINGNSDILVGNQFAWSLKGYSDREIAKVDYNKAAEELKIKLEAGVPHSYFNSTYASIKVQNSSGSVLYNKEIVGNRQQNTESQTVSVKVGDYIELTHIEGDAVKEKTRATLTNLENNKNETIGKTARYLVTKEGLEKVEKMPETTILDGKQFAWSLKGYSDREIAKVDYNKTAEELKIKLEAGVPHSYFNSTYASIKVQGSSGNVMYNKEIMGNRQQNAETQTVPIKVGDYIEFTHIEGEAAKEKTRATLTNLENRKQEYIGKKRTYQVTSTGLLRQ

SEQ ID NO: 800 - protein, 653 aa, Bacillus Sp.
MFKEQTNGRLKKIVIITAACTMMSMYGAPISSTKAAIRSHAPSVYVTPQNTAASDIISIDWSPVQTAPYTYWAVHNWNQGGEGGGYAGFQQQSGFDQNGKRTLHFALWDPIASNQAIKAEYLSPTAEASRFGGEGTGLKVQTTYNWKDSEWYRMTLRSWQEDGHTKFGQWIKDNKLNQWKLVAIMDHPVANVAFNYGLSMFQEDWAGNGQDVREARLKNGYSRKVSDKQWNSWNNQRISGQHDTSYQYDGGATSEYIWVKAGGNTQSTIGTGKIFNINQPSQPEMGNLDYDIQNISFEAEKLNVSWKLKEQSTPQFKGKIEIYDNEKLMGQPLKVIDNIKSYQTEVSQTMQLPQTAFAKITLTDIFDRTVEKKVGITNGNSDILVGNQFAWSLKGYSDREIAKVDYNKAAEELKIKLEAGVPHSYFNSTYASIKVQNSSGSVLYNKEIVGNRQQNTETQTVSVKVGDYIELTHIEGDAVKEKTRATLTNLENNKNETIGKTARYLVTKEGLKKVEKMPETTILDGNQFAWSLKGYSDREIAKVDYNKTAEELKIKLEAGIPHSYFNSTYASIKVQSSSSSVLYNKEIIGNRQQNAETQTVPLKVGDYIEFTHIEGEAAKEKTRATLTNLENGKQEYIGKKRTYQVTSTGLIRK

SEQ ID NO: 801 - protein, 653 aa, Bacillus Sp.
MFKVKTNGRIKKIVMISAACTMMSMYGAPISSTEAAIRSHAPSVYVTPQNTAASDIISIDWSPIQTAPYTYWAVHNWNQGGEGGGYAGFQQQSGFDQTGKRTLHFALWDPIASNQAIKAEYLSPTSEASRFGGEGTGLKVQTTYNWKDSEWYRMTLRSWQEDGHTKFGQWIKDNKLNQWKLVAIMDHPVANVAFNYGLSMFQEDWAGNGQDVREARLKNGYSRKVSDKQWNSWNNQRISGQHDTSYQYDGGATSEYVWVKAGGNTQSTIGTGKTFNINQPSQPEMGNLDFDIQNIRFENEKLNVSWKLKEQSTPQFKGKIEIYDNEKLTGQALKVIDNIKSYQTEVSQTMQLPQTAYAKITLTDIFDRTVEKKVGITNGNSDILVGNQFAWSLKGYSDREIAKVDYNKAAEELKIKLEAGVPHSYFNSTYASIKVQNSSGSVMYNKEIMGNRQQNAEIQTVPVKVGDYLEFTHIEGDAVKEKTRATLTNLENNKNETFGKSARYQVTKEGLKKVEKMPETTILDGKQFAWSLKGYSDREIAKVDYNKTAEELKIKLEAGVPHSYFNSTYASIKVQNSSGSVMYNKEIMGNRQQNAETQIVPVKEGDYIEFTHIEGEAAKEKTRATLTNLENEKQEYIGKKRTYRVTSTGLIRQ

SEQ ID NO: 802 - protein, 653 aa, Bacillus Sp.
MFKVKTRGKIKEIVMVSTACTMLSMYGAPISSTEAATRSHAPSVYVTPQNTAASDIISIDWSPVQTAPYTYWAVHNWNQGGEGGGYAGFQQQSGFDQFGKRTLHFALWDPIASNQAIKAEYLSPTSEASRFGGEGTGLKVQTTYNWKDSEWYRMTLRSWQEDGHTKFGQWIKDNKLNQWKLVAIMDHPVANVAFNYGLSMFQEDWAGNGQDVREARLKNGYSRKVSDKQWNSWNNQRISGQHDTSYQYDGGATSEYLWVRAGGNTQSTIGTGKTFNINQPSQPEMGNLDFDIQNTRFEDGKLNVSWKLKEQSTPQFKGKIEIYDNEKLMGQPLKVIDNIKSYKTEVSQTMQLPQTAFAKITLTDIFDRTVEKKVEITNGNSDILVGNQFAWSLKGYSDREIAKVDYNKTAEELKIKLEAGVPHSYFNSTYASIKVQNSSGSVLYNKEIMGNRQQNAETQTVPVKVGDYLEFTHIEGEAAKEKTRATLTNLENNKNETIGKSARYEVTKEGLKKVEKMPETTILDGKQFAWSLKGYSDREIAKVDYNKTAEELKIKLEAGVPHSYFNSTYASIKVQNSSGSVLYNKEIMGNRQQNAETQTVPVKEGDYIEFTHIEGEVAKEKTRATLTNLENGKQEYIGKKRTYRVTSTGLIRQ

SEQ ID NO: 803 - protein, 653 aa, Bacillus Sp.
MFKVKTRGKIKRIVMVSTACTMLSMYGAPISSTEAATRSHAPSVYVTPQNTAASDIISIDWSPVQTAPYTYWAVHNWNQGGEGGGYAGFQQQSGFDQFGKRTLHFALWDPIASNQAIKAEYLSPTSEASRFGGEGTGLKVQTTYNWKDSEWYRMTLRSWQEDGHTKFGQWIKDNTLNQWKLVVIMDHPVTNVAFNYGLSMFQEDWAGNGQDVREARLKNGYSRKVSDKQWNSWNNQRISGQHDTSYQYDGGATSEYLWVRAGGNTQSTIGTGKTFNINQPSQPEMGNLDFDIQNTRFEAGKLNVSWKLKEQSTPQFKGKIEIYDNEKLAGQPLKVIDNIKSYQTEVSQTMQLPQTAFAKITLTDIFDRTVEKKVGITNGNSDILVGNRFAWSLKGISDFEFAKINFNKSTEEMQIDLKAGVPHHYFNETYASIKVQNASGKVVYNNDIYGNKQQNAETQTVPVKVGDYIELTHIEGDAVKEKKRATLMNLENNKNETIGKTARYQVTKEGLKKVEKMPETTILDGKQFAWSLKGYSDREIAKVDYNQTAEELKIKLEAGVPHSYFNSTYASIKVQNSSGSVMYNKEIMGNRQQNAETQTVPIKVGDYIEFTHIEGDAAKEKTRATLTNLENGKQEYIGKKRTYQVTSTGLIRQ

SEQ ID NO: 804 - protein, 653 aa, Bacillus Sp.
MFKVKTRGKIKRIVMVSTACTMLSMYGAPISSTEAATRSHAPSVYVTPQNTAASDIISIDWSPVQTAPYTYWAVHNWNQGGEGGGYAGFQQQSGFDQFGKRTLHFALWDPIASNQAIKAEYLSPTSEASRFGGEGTGLKVQTTYNWKDSEWYRMTLRSWQEDGHTKFGQWIKDNTLNQWKLVVIMDHPVTNVAFNYGLSMFQEDWAGNGQDVREARLKNGYSRKVSDKQWNSWNNQRISGQHDTSYQYDGGATSEYLWVRAGGNTQSTIGTGKTFNINQPSQPEMGNLDFDIQNTRFEAGKLNVSWKLKEQSTPQFKGKIEIYDNEKLAGQPLKVIDNIKSYQTEVSQTMQLPQTAFAKITLTDIFDRTVEKKVGITNGNSDILVGNRFAWSLKGISDFEFAKINFNKSTEEMQIDLKAGVPHHYFNETYASIKVQNALGKVVYNNDIYGSKQQNAETQTVPVKVGDYIELTHIEGDAVKEKKRATLMNLENNKNETIGKTARYQVTKEGLKKVEKMPETTILDGKQFAWSLKGYSDREIAKVDYNQTAEELKIKLEAGVPHSYFNSTYASIKVQNSSGSVMYNKEIMGNGQQNAETQTVPIKVGDYIEFTHIEGDAAKEKTRATLTNLENGKQEYIGKKRTYQVTSTGLIRQ

SEQ ID NO: 805 - protein, 629 aa, Bacillus Sp.
MYGAPISSTEAATRSHAPSVYVTPQNTAASDIISIDWSPVQTAPYTYWAVHNWNQGGEGGGYAGFQQQSGFDQFGKRTLHFALWDPIASNQAIKAEYLSPTSEASRFGGEGTGLKVQTTYNWKDSEWYRMTLRSWQEDGHTKFGQWIKDNTLNQWKLVVIMDHPVTNVAFNYGLSMFQEDWAGNGQDVREARLKNGYSRKVSDKQWNSWNNQRISGQHDTSYQYDGGATSEYLWVRAGGNTQSTIGTGKTFNINQPSQPEMGNLDFDIQNTRFEAGKLNVSWKLKEQSTPQFKGKIEIYDNEKLAGQPLKVIDNIKSYQTEVSQTMQLPQTAFAKITLTDIFDRTVEKKVGITNGNSDILVGNRFAWSLKGISDFEFAKINFNKSTEEMQIDLKAGVPHHYFNETYASIKVQNASGKVVYNNDIYGNKQQNAETQTVPVKVGDYIELTHIEGDAVKEKKRATLMNLENNKNETIGKTARYQVTKEGLKKVEKMPETTILDGKQFAWSLKGYSDREIAKVDYNQTAEELKIKLEAGVPHSYFNSTYASIKVQNSSGSVMYNKEIMGNRQQNAETQTVPIKVGDYIEFTHIEGDAAKEKTRATLTNLENGKQEYIGKKRTYQVTSTGLIRQ

SEQ ID NO: 806 - protein, 613 aa, Bacillus Sp.
MFKVKTRGKIKRIVMVSTACTMLSMYGAPISSTEAATRSHAPSVYVTPQNTAASDIISIDWSPVQTAPYTYWAVHNWNQGGEGGGYAGFQQQSGFDQFGKRTLHFALWDPIASNQAIKAEYLSPTSEASRFGGEGTGLKVQTTYNWKDSEWYRMTLRSWQEDGHTKFGQWIKDNTLNQWKLVAIMDHPVANVAFNYGLSMFQEDWAGNGQDVREARLKNGYSRKVSDKQWNSWNNQRISGQHDTSYQYDGEATSEYLWVRAGGNTQSTIGTGKTFNINQPSQPEMGNLDFDIQNTRFEAGKLNVSWKLKEQSTPQFKGKIEIYDNEKLMGQPLKVIDNIKSYQTEVSQTMQLPQTAFAKITLTDIFDRTVEKKVGITNGNSDILVGNRFAWSLKGISDFEFAKINFNKSTEEMQIDLKAGVPHHYFNETYASIKVQNASGKVVYNNDFYGNKQQNAESQKVPVKVGDYIELTHLEGVHRANFTNLDNSKQESFGKKAMYEVTKESLKKVEKMPETTILDGKQFAWSLKGYSDREIAKVDYNQTAEELKIKLEAGVPHSYFNSTYASIKVQNSSGSVMYNKEIMGNRQQNAETQTVPVKVGDYIEFTHIEGEAA

SEQ ID NO: 807 - protein, 787 aa, Bacillus Sp.
MFKVKTNGRIKKIVMISAACTMMSMYGAPISSTEAAIRSHAPSVYVTPQNTAASDIISIDWSPIQTAPYTYWAVHNWNQGGEGGGYAGFQQQSGFDQAGKRTLHFALWDPIASNQAIKAEYLSPTSEASRFGGEGTGLKVQTTYNWKDSEWYRMTLRSWQEDGHTKFGQWIKDNKLNQWKLVAIMDHPVANVPFNYGLSMFQEDWAGNGQDVREARLKNGYSRKVSDKQWNSWNNQRISGQHDTSYQYDGGATSEYLWVKAGGNTQSTIGTGKTFNINQPSQPEMGNLDFDIQNIRFENEKLNVSWKLKEQSTPQFKGKIEIYDNEKLTGQALKVIDNIKSYQTEVSQTMQLPQTAYAKITLTDIFDRTVEKKVAITNGNSDILVGNQFAWSLKGISDFEFAKINFNKSKEEMQIDLKAGVPHHYFNEIYASIKVQNASGKVVYNKDIYGNKQQNAESQKVPVKVGDYIELTHLEGVNRATFKNVDNSKQESFGKKAMYEITKEGLKKVEKMPEATILDGNQFVWSLKGYSDREIAKVDYNKTSEELKIKLEAGVPHSYFNSTYASIKVQNSSGSVIYNKEIVGNRQQNAETQTVSVKVGDYIELTHIEGDAVNEKTRATLTNLENNKNETIGKTARYQVTTEGLKKVEKMPETTILDGKQFAWSLKGYSDREIAKVDYNKTAEELKIKLEAGIPHSYFNSTYASIKVQNSSGSVMYNKEIVGNRQQNAEIKTVPIKVGDYIEFTHIEGEAAKEKTRANLTNLENGKQEYIGKKRIYQITSTGLIRQ

SEQ ID NO: 808 - protein, 787 aa, Bacillus Sp.
MFKVKINGRIKKIVMISAACTMMSMYGAPISSTEAAIRSHAPSVYVTPQNTAASDIISIDWSPIQTAPYTYWAVHNWNQGGEGGGYAGFQQQSGFDQTGKRTLHFALWDPIASNQAIKAEYLSPTSEASRFGGEGTGLKVQTTYNWKDSEWYRMTLRSWQEDGHTKFGQWIKDNKLNQWKLVAIMDHPVANVPFNYGLSMFQEDWAGNGQDVREARLKNGYSRKVSDKQWNSWNNQRISGQHDTSYQYDGGATSEYLWVKAGGNTQSTIGTGKTFNINQPSQPEMGNLDFDIQNIRFENEKLNVSWKLKEQSTPQFKGKIEIYDNEKLTGQALKVIDNIKSYQTEVSQTMQLPQTAYAKITLTDIFDRTVEKKVAITNGNSDILVGNQFAWSLKGISDFEFAKINFNKSKEEMQIDLKAGVPHHYFNETYASIKVQNASGRVVYNKDIYGNKQQNAESQKVPVKVGDYIELTHLEGVNRATFKNVDNSKQESFGKKAMYEITKEGLKKVEKMPEATILDGNQFVWSLKGYSNREIAKVDYNKTSEELKIKLEVGIPHSYFNSTYASIKVQNSSGSVICNKEIVGNRQQNAETQTVSVKVGDYIELTHIEGDTVNEKTRATLTNLENNKNETIGKTARYQVTTEGLKKVEKMPETTILDGKQFAWSLKGYSDREIAKVDYNKTAEELKIKLEAGIPHSYFNSTYASIKVQNSSGSVMYNKEIVGNRQQNAETKTVPIKVGDYIEFTHIEGEAVKEKTRANLTNLENGKQEYIGKKRIYQVTSTGLIRQ

SEQ ID NO: 809 - protein, 661 aa, Bacillus Sp.
MISQKTKQRFNKVIIITAACSMFSMFGTSILHTKAATHSAAPAVYVSPQNIPASDIISIDWSPVQTPPYTYWAVHNWNAGGEAGGYAGFQQQSGFDENGKRTLHFALWDPISSKEAIKAEYLSPNSQAGPFGGEGTGMKVQTTYGWKDYNWYTMTMRSWQENGHTKFGQWMKDVTKNKWHQIAIMDFPVANVAFNHGLGMFQEDWADSGQNVREARLKNGYSRKLVDKQWSSWNNQSISGTHDNTYQYDGGSTSEYVWVKAGGNTQSTIGAGKIFTLNQPTQPEIGKLDFDIQSIYYENEKLNVSWKLKENSTPQFKGKIEIYNNENMTGQPINVINDIKSYQNGISQSISLPTNAYAKIVLTDIFDQTVEKKVQIKNESPNIFEGNEFAWSLKGIGDFEFAKVNLNKSTEEMQIDLKAGVPHDYFDSTYASIKVQNTSGKVVYNKEIYGNKQQNAESQKVPVKVGDYIELTHLEGVHRATLTNVDNSKQESFGKKALYEVTKEGLKKIEKMPEATILEGNKFAWSLKGYSDREIAKVDYDKTVEEMKVKLEAGVPHSYFASTYASIKVQNSSGNVLYNKEIVGNKQQNAESQTVPVKVGDYIEFTHIEGEATKEKTRATLINLENNKNETIGKTARYQVTKEGLKKVEKMPETTVLDGNH

SEQ ID NO: 810 - DNA, 1295 bp, Artificial sequence
  Optimized for E. Coli
ccatgggcaagctgctggaactgaaaagcgtgtatagcgagcaggaacaagagcgtttctacacccgtagcatcagcctgggtgactgggattacagcgcgatcattaagagcagcgttatgttcggtctgggccagatcccggtggttggtaaagcgctgagcaccattgtgggcctgttttggccgaagaacgaaaaagatgtttggcaaaagagcctggacgaactgcgtgagtatatcgataaccagattctggcgaccatccaaggtattctgaacggcgaactgcgtgagatccagaagaaaatggagtatgttgcgcgtctgctggaggaaagcccgggcagcccggaagcgtgcagcgagtataaaaacctgcaattctacctggttggcaaggacgaaaaattccgtagctttgatgagctgaccaactataagctgatgccgatgtacgcgagcatgatcctgctgcaggcgagctactggaaaatgggtattgataagaaagaccaaatcggcctgagcagcattgacctgaacagcctgaagaaccacatcgacgatctggcggatagcagccgtaactatatcaaccgtatttacgaaaccgagctggaccgtacctatgaaaacagccgtccggatgaggtggcgaacaacatgtttgcggttcgtggttacagcctgctgcacggcgtggaagcggttgaggtggttaagaacattcgtgacctggatttcgacaaacgttttaacatcaacgtgattagctatagcaccgcggttggcaccatcaccggtggcatgattgcgcaggcgctgaccccggacagcgaaatggcgcaaccgctgtgcccggaagtgttcggtcagcaagcgaaccgtatcgttcagatcattggttatagcggcccgcgtatcaacagcctgtttcgtattggtggcctggaaatcatttacgagaacggtgatagcagcctgctgggtgaacgtgtgggcaaccgtgatgtttttgacctgaacggtagcctgattaagaccgtggaaatgcgttaccagggcctgatggacgaggttaaattcaccctgtttgatggtcgtgtgatgcaggttggtcaaggcgagagctacagcggctatgtgaaatacgaagttgagggtcactatatcagcggcgtgttcctgagccgtgaccgtgcgacctatccgggtcgtaccagcaccgcgagcgtgagctttaacatggttccggcgattagccaccaccaccaccaccactaataagaattc

SEQ ID NO: 811 - DNA, 431 bp, Artificial sequence
  Optimized for E. Coli
ccatgggtaaggaccagttcagcaacaacgagatcgaaaaactgagccgtggtgttggcctggaaaccagcccggcggatgaaagcgtgcagctgctgagcggtggcacctttaccgttccgaagcacggtagcgtgcaagcggcgaaatacagcaccccggttatcccggagattcacaagagctattggatcttcaacgcgggcaaagcgaacaagattaaagcggtgttttactggagccacagcttcaccagcagctggtttgagtatagcagcgtggaagttggtattggcgaggaaaagaaactgcaggcgccgagcaacagcctgtactatagcaaggtggttctgttcaacggcaccgaccaaaacgcgaccgtgagcgttaccgtggcgaaacaccaccaccaccaccactaataagaattc

SEQ ID NO: 812 - DNA, 1112 bp, Artificial sequence
  Optimized for E. Coli
ccatggttgagctgctgaagccgatcgtgtacccggacgatgcgaacaaccaagagaacgacattgaagtgagcttccagctgagcccggacaccgattatatcctgagcaacagcaacctgaacaaacaattcattccgtttagcggcgagtactggctgcagaactacagcccgtatccgttctttaccgaccgtaaccagctgcaatttgtttacccggattatagcaagggtgttatggtgaaatacgtggacgaggaaggcaacgaaatccacgatccgcaaaccattagcggtagcaagggcgacgtttacgatgcgagcaccgaccagtataaactggtgctggacggttacaccctggataccagcaagctgccgcaaaacagcatcggcaacttcaaagaggcgctgcagaccgttacctacgtgtatagcaagaacccggtggttgcggcggatgttaccgtgcgttatgtggatatcgagaacaacccgattagcgaagatatcattctgcagggtaacatcggcgaaaactactacaccgacaagaaaaacatcaaggattacaccctgaaagaggtgcagggtaacagcagcggccaattcagcgaaaaggcgcagaccgttacctacatctataagaaaaacgagctgccgattgcgaccggcaaggtggttgtgaaatatatcgacaccgatggcaagagcattctgaaagacgttgtgcgtaccggtaccgttggcgaagattatatcaccgaggagaagaacattagcggttacacctttcaaggtatccgtggcaacagcaagggcaaatacaccgacaagatccagaccattacctacgtttataccaaaaaccacatcattaagccgaaagatgagctggtgaacagcggtaccaagatcattaacaaaaccaacccgaaggttaaaaacagcagcagcgaaaagagccagaaactgccggaaaccggcgaaaacaagaaacgtagcatcctgttctttattagcggtctgaccctgatcaccctgggcagcaccatcattgtttttcgtcacaagaaagaacaccaccaccaccaccactaataagaattc

SEQ ID NO: 813 - DNA, 3665 bp, Artificial sequence
  Optimized for E. Coli
ccatgggtcaccaccaccaccaccacgatgagcgtgcgagccgtccgcgtttttacaccccgaaagcgagcggtgaccgtgcgagcttccgtaccagcgaattttacgcgaactggggcctgaacctgcaccattttgatgcggcgtacgcggcgggtgcgaccggtcagaacgtgaaggttggtcaactggacaacccgctgtacgttaaacacccggagctggcgggtatcaactttagcgcggttggtagctatccgctggcgaccaccccggcgtttgatgcgggtaccggcaagccggcgtaccacggtatgcacgttgcgggcatcattgcggcgcgtaaggatggtaagggtatgcatggtggcgcgtttggtgcgaccgactttgttaccggcaacttccgtcagaccagccaggcggtgcagcaagcgggtggcaccctgagcaagctgggtaaaaccattgtggacgcgggcgcggattttatcaaccacagctacggttataacttcggcatctatgcgatcccgatggcgctgccggagggccagtttggtagccacggcccggatattcgtcacatgcagcgttaccgtgaccgtcaacacatcgaactgagcagcgcgaacggtgtggttaacgttagcagcgcgggcaacgatcgttactatgcggcgtacaagaccgcgtttaacaaatatgacgcgcgtccgcgtctgttccgtggtatcggcaacggtgcgggcatcaacagcattccgtacatgaaccaccgtgagaagaacctgaccgacgcggattggagccgtatcgaaaaaggtattctgagcgcggttatcctgaacggcaccaaggatattaacagctacagcaacatctgcggtattagcaaatattggtgcgtgggtgcggcgggtggcatgctgaccgagccggacaaagcgtatgcgaccaccctgccggcgctgccgtacccggttgacttctatcacccggatgcgagcggtcagaagtacagctatgaaaaactgaacggcaacatcagcagcgatcgttatcgtattctgagcctggcggttaccagcaacgctccgccgggtagcccggaggcggaagtgatggacccgaaaaacctgcaaccgatttatcgtatggcgatgggtaccagcatggcggcgccgaccctgaccgcgggcctggcggtgaccaagagccgttttccgtacctgcagaactggcaaatccgtgacattgttctgagcaccgcgcaggatattggtgcgccgggcattgaccgtgtgtatggttggggcgcgatggatctggaggcggcgattggtggcccgcgtagcctgtttgcgctgcgtcgtgactacatcgaaaaactggcgcaatatgaggttgaagcggcggataagtacaacccgatcgtggcgaaagcggactactatgcgacccaggcgtatgagctgaagatccaaatgattgaaaacgcgaaacgtgcggcggaggcggaaaaggcgggtaaccagaaagaggcggcgcaactgctggcgctgaacaaacaactggcgccgcaagaagcggcgttccgtaaacaggcgtatgagcacgaactgacccgtattcagccgaacaacgaggcggataccccgcaaaacgcgtttgaatacatcaacttcgtggttaacattccgggtaagaaaagcgaggcgtgcgcggaagatgcgtgcgttgcggatgtgtggaccaacgacatcagcggtccgggtggcctggaaaagaaaggtgctggcctgctggcgctggcgggtaacaaccactacaccggtggcaccaaaattagcgacggtgtgctgcagtttggcatcggtggcaccaccggtagcgttaccggcaacattctgaacaacagcagcctggtgttcgcgcgtagcgatgagtggagctacaaggacagcatcaccggtagcggcgaagtgctggttctgggtggcggtacctttcgtctgcaaggtgataacacctacaccggcccgacccacgtttatgatggtcgtttcgcggtggacggcagcaccatcagcaacaccatcatttatggcggtggcaccctgagcggtaacggtcgtgttggtggcatccacgtgcgtcaggacggtattgttagcccgggtaacagcatcggcaccctgaccgtgatgaaaagcggtagcgcgggtgcgggtgcgggtaacgcggtttttgagccgggcagccgtctggcgatcgaaattgatggccaaggtaaccacgacgcgctgaaggtggagaacgcggcgaacattcacggtggcatggtggatgttggtgtggcgaacctgagccgtacccagctggcgcagcaagttcgtcagagcatgcaaaaaccgtacgaaattctgaccgcgggtgcgggtgtgagcggtgcgtttgaccaagcgcgtctggacatcgatctgccgttcattgcggcgggcctgcgttatagcccgcagaccgttggtctggtgctgggccgtagccacctgggtttcggtagcgttggtcaaacctataaccagcgtcaaatcggcgatggtattgagagcctgagcccgggtcaaccgctgtatgatggcctgctgaccagcgcgagccgtcaagaagcggttagcagcctgcagcaactgagcaacgtggatattcacgcgagcctgaagcgtaccctgatcgataacacccgttttatgcgtgatgcggcgctgggtcgtagcggttttgcgagcatgccgaacatcggtgcgagcgcggacggtaaactgctgggcgaaaccaacatgaacgtttggggcaaggtgctgggcagctggcagaagcacaaaggcgatggtaacgcggcgagcctggaccgtaccatcggtggcctgatttttggtgttgaccacctgatgaaccgtaactggcgtgcgggtgcgctggttggtctgagcaacagcagcctgaagagcgatcgtgcgagcgcgaaaattgacagctaccagttcggtgcgtatgcggcgaccgagcgtgaacgtctgggtctgcgtgttggtgcgagcctggcgcaccatgaaatcgcgacccgtcgtggtggctacccggatctgaccagcatgaacaaagcggactatagcgcgaacagcctgcaggtttacggcgagctgggctataagtttaccgcgaacgcggtgatgatcgaaccgttcgttaacagcgcgtacgtgcacctgcgtaccaacgcgtttgaggaagacggtgatgcgagcaaggttagcggcaaacgtcaaagcgcgaacgtggttagcagcattctgggtgcgcgtatcagcaacattgtggagagcggtagcggtaccgcgttccgtctgagcggtatgatcggctggaactacaacgttggtgatatcgcgccgattgcgagcgtgaactatcgtggtggcaacacctttgacgttcgtggtattccgctgagccgtaacgcgttcgttaccgaagtgggtatccaggcgagcccgaagaaaaacctgagcgcgggcctgtactatgatggtcgttttggccgtaaggtgagcgaccacagcctgagcctgggtatcagctacgcgttctaataagaattc

SEQ ID NO: 814 - DNA, 3665 bp, Artificial sequence; identical to SEQ ID NO: 813
  Optimized for E. Coli

SEQ ID NO: 815 - DNA, 3683 bp, Artificial sequence
  Optimized for E. Coli
ccatgggtcaccaccaccaccaccacgatgagcgtgcgagccgtccgcgtttttacaccccgaaagcgagcggtgaccgtgcgagcttccgtaccagcgaattttacgcgaactggggcctgaacctgcaccattttgatgcggcgtacgcggcgggtgcgaccggtcagaacgtgaaggttggtcaactggacaacccgctgtacgttaaacacccggagctggcgggtatcaactttagcgcggttggtagctatccgctggcgaccaccccggcgtttgatgcgggtaccggcaagccggcgtaccacggtatgcacgttgcgggcatcattgcggcgcgtaaggatggtaagggtatgcatggtggcgcgtttggtgcgaccgactttgttaccggcaacttccgtcagaccagccaggcggtgcagcaagcgggtggcaccctgagcaagctgggtaaaaccattgtggacgcgggcgcggattttatcaaccacagctacggttataacttcggcatctatgcgatcccgatggcgctgccggagggccagtttggtagccacggcccggatattcgtcacatgcagcgttaccgtgaccgtcaacacatcgaactgagcagcgcgaacggtgtggttaacgttagcagcgcgggcaacgatcgttactatgcggcgtacaagaccgcgtttaacaaatatgacgcgcgtccgcgtctgttccgtggtatcggcaacggtgcgggcatcaacagcattccgtacatgaaccaccgtgagaagaacctgaccgacgcggattggagccgtatcgaaaaaggtattctgagcgcggttatcctgaacggcaccaaggatattaacagctacagcaacatctgcggtattagcaaatattggtgcgtgggtgcggcgggtggcatgctgaccgagccggacaaagcgtatgcgaccaccctgccggcgctgccgtacccggttgacttctatcacccggatgcgagcggtcagaagtacagctatgaaaaactgaacggcaacatcagcagcgatcgttatcgtattctgagcctggcggttaccagcaacgctccgccgggtagcccggaggcggaagtgatggacccgaaaaacctgcaaccgatttatcgtatggcgatgggtaccagcatggcggcgccgaccctgaccgcgggcctggcggtgaccaagagccgttttccgtacctgcagaactggcaaatccgtgacattgttctgagcaccgcgcaggatattggtgcgccgggcattgaccgtgtgtatggttggggcgcgatggatctggaggcggcgattggtggcccgcgtagcctgtttgcgctgcgtcgtgactacatcgaaaaactggcgcaatatgaggttgaagcggcggataagtacaacccgatcgtggcgaaagcggactactatgcgacccaggcgtatgagctgaagatccaaatgattgaaaacgcgaaacgtgcggcggaggcggaaaaggcgggtaaccagaaagaggcggcgcaactgctggcgctgaacaaacaactggcgccgcaagaagcggcgttccgtaaacaggcgtatgagcacgaactgacccgtattcagccgaacaacgaggcggataccccgcaaaacgcgtttgaatacatcaacttcgtggttaacattccgggtaagaaaagcgaggcgtgcgcggaagatgcgtgcgttgcggatgtgtggaccaacgacatcagcggtccgggtggcctggaaaagaaaggtgctggcctgctggcgctggcgggtaacaaccactacaccggtggcaccaaaattagcgacggtgtgctgcagtttggcatcggtggcaccaccggtagcgttaccggcaacattctgaacaacagcagcctggtgttcgcgcgtagcgatgagtggagctacaaggacagcatcaccggtagcggcgaagtgctggttctgggtggcggtacctttcgtctgcaaggtgataacacctacaccggcccgacccacgtttatgatggtcgtttcgcggtggacggcagcaccatcagcaacaccatcatttatggcggtggcaccctgagcggtaacggtcgtgttggtggcatccacgtgcgtcaggacggtattgttagcccgggtaacagcatcggcaccctgaccgtgatgaaaagcggtagcgcgggtgcgggtgcgggtaacgcggtttttgagccgggcagccgtctggcgatcgaaattgatggccaaggtaaccacgacgcgctgaaggtggagaacgcggcgaacattcacggtggcatggtggatgttggtgtggcgaacctgagccgtacccagctggcgcagcaagttcgtcagagcatgcaaaaaccgtacgaaattctgaccgcgggtgcgggtgtgagcggtgcgtttgaccaagcgcgtctggacatcgatctgccgttcattgcggcgggcctgcgttatagcccgcagaccgttggtctggtgctgggccgtagccacctgggtttcggtagcgttggtcaaacctataaccagcgtcaaatcggcgatggtattgagagcctgagcccgggtcaaccgctgtatgatggcctgctgaccagcgcgagccgtcaagaagcggttagcagcctgcagcaactgagcaacgtggatattcacgcgagcctgaagcgtaccctgatcgataacacccgttttatgcgtgatgcggcgctgggtcgtagcggttttgcgagcatgccgaacatcggtgcgagcgcggacggtaaactgctgggcgaaaccaacatgaacgtttggggcaaggtgctgggcagctggcagaagcacaaaggcgatggtaacgcggcgagcctggaccgtaccatcggtggcctgatttttggtgttgaccacctgatgaaccgtaactggcgtgcgggtgcgctggttggtctgagcaacagcagcctgaagagcgatcgtgcgagcgcgaaaattgacagctaccagttcggtgcgtatgcggcgaccgagcgtgaacgtctgggtctgcgtgttggtgcgagcctggcgcaccatgaaatcgcgacccgtcgtggtggctacccggatctgaccagcatgaacaaagcggactatagcgcgaacagcctgcaggtttacggcgagctgggctataagtttaccgcgaacgcggtgatgatcgaaccgttcgttaacagcgcgtacgtgcacctgcgtaccaacgcgtttgaggaagacggtgatgcgagcaaggttagcggcaaacgtcaaagcgcgaacgtggttagcagcattctgggtgcgcgtatcagcaacattgtggagagcggtagcggtaccgcgttccgtctgagcggtatgatcggctggaactacaacgttggtgatatcgcgccgattgcgagcgtgaactatcgtggtggcaacacctttgacgttcgtggtattccgctgagccgtaacgcgttcgttaccgaagtgggtatccaggcgagcccgaagaaaaacctgagcgcgggcctgtactatgatggtcgttttggccgtaaggtgagcgaccacagcctgagcctgggtatcagctacgcgttccaccaccaccaccaccactaataagaattc

SEQ ID NO: 816 - DNA, 3683 bp, Artificial sequence; identical to SEQ ID NO: 815
  Optimized for E. Coli

SEQ ID NO: 817 - DNA, 3662 bp, Artificial sequence
  Optimized for E. Coli
ccatggatgagcgtgcgagccgtccgcgtttttacaccccgaaagcgagcggtgaccgtgcgagcttccgtaccagcgaattttacgcgaactggggcctgaacctgcaccattttgatgcggcgtacgcggcgggtgcgaccggtcagaacgtgaaggttggtcaactggacaacccgctgtacgttaaacacccggagctggcgggtatcaactttagcgcggttggtagctatccgctggcgaccaccccggcgtttgatgcgggtaccggcaagccggcgtaccacggtatgcacgttgcgggcatcattgcggcgcgtaaggatggtaagggtatgcatggtggcgcgtttggtgcgaccgactttgttaccggcaacttccgtcagaccagccaggcggtgcagcaagcgggtggcaccctgagcaagctgggtaaaaccattgtggacgcgggcgcggattttatcaaccacagctacggttataacttcggcatctatgcgatcccgatggcgctgccggagggccagtttggtagccacggcccggatattcgtcacatgcagcgttaccgtgaccgtcaacacatcgaactgagcagcgcgaacggtgtggttaacgttagcagcgcgggcaacgatcgttactatgcggcgtacaagaccgcgtttaacaaatatgacgcgcgtccgcgtctgttccgtggtatcggcaacggtgcgggcatcaacagcattccgtacatgaaccaccgtgagaagaacctgaccgacgcggattggagccgtatcgaaaaaggtattctgagcgcggttatcctgaacggcaccaaggatattaacagctacagcaacatctgcggtattagcaaatattggtgcgtgggtgcggcgggtggcatgctgaccgagccggacaaagcgtatgcgaccaccctgccggcgctgccgtacccggttgacttctatcacccggatgcgagcggtcagaagtacagctatgaaaaactgaacggcaacatcagcagcgatcgttatcgtattctgagcctggcggttaccagcaacgctccgccgggtagcccggaggcggaagtgatggacccgaaaaacctgcaaccgatttatcgtatggcgatgggtaccagcatggcggcgccgaccctgaccgcgggcctggcggtgaccaagagccgttttccgtacctgcagaactggcaaatccgtgacattgttctgagcaccgcgcaggatattggtgcgccgggcattgaccgtgtgtatggttggggcgcgatggatctggaggcggcgattggtggcccgcgtagcctgtttgcgctgcgtcgtgactacatcgaaaaactggcgcaatatgaggttgaagcggcggataagtacaacccgatcgtggcgaaagcggactactatgcgacccaggcgtatgagctgaagatccaaatgattgaaaacgcgaaacgtgcggcggaggcggaaaaggcgggtaaccagaaagaggcggcgcaactgctggcgctgaacaaacaactggcgccgcaagaagcggcgttccgtaaacaggcgtatgagcacgaactgacccgtattcagccgaacaacgaggcggataccccgcaaaacgcgtttgaatacatcaacttcgtggttaacattccgggtaagaaaagcgaggcgtgcgcggaagatgcgtgcgttgcggatgtgtggaccaacgacatcagcggtccgggtggcctggaaaagaaaggtgctggcctgctggcgctggcgggtaacaaccactacaccggtggcaccaaaattagcgacggtgtgctgcagtttggcatcggtggcaccaccggtagcgttaccggcaacattctgaacaacagcagcctggtgttcgcgcgtagcgatgagtggagctacaaggacagcatcaccggtagcggcgaagtgctggttctgggtggcggtacctttcgtctgcaaggtgataacacctacaccggcccgacccacgtttatgatggtcgtttcgcggtggacggcagcaccatcagcaacaccatcatttatggcggtggcaccctgagcggtaacggtcgtgttggtggcatccacgtgcgtcaggacggtattgttagcccgggtaacagcatcggcaccctgaccgtgatgaaaagcggtagcgcgggtgcgggtgcgggtaacgcggtttttgagccgggcagccgtctggcgatcgaaattgatggccaaggtaaccacgacgcgctgaaggtggagaacgcggcgaacattcacggtggcatggtggatgttggtgtggcgaacctgagccgtacccagctggcgcagcaagttcgtcagagcatgcaaaaaccgtacgaaattctgaccgcgggtgcgggtgtgagcggtgcgtttgaccaagcgcgtctggacatcgatctgccgttcattgcggcgggcctgcgttatagcccgcagaccgttggtctggtgctgggccgtagccacctgggtttcggtagcgttggtcaaacctataaccagcgtcaaatcggcgatggtattgagagcctgagcccgggtcaaccgctgtatgatggcctgctgaccagcgcgagccgtcaagaagcggttagcagcctgcagcaactgagcaacgtggatattcacgcgagcctgaagcgtaccctgatcgataacacccgttttatgcgtgatgcggcgctgggtcgtagcggttttgcgagcatgccgaacatcggtgcgagcgcggacggtaaactgctgggcgaaaccaacatgaacgtttggggcaaggtgctgggcagctggcagaagcacaaaggcgatggtaacgcggcgagcctggaccgtaccatcggtggcctgatttttggtgttgaccacctgatgaaccgtaactggcgtgcgggtgcgctggttggtctgagcaacagcagcctgaagagcgatcgtgcgagcgcgaaaattgacagctaccagttcggtgcgtatgcggcgaccgagcgtgaacgtctgggtctgcgtgttggtgcgagcctggcgcaccatgaaatcgcgacccgtcgtggtggctacccggatctgaccagcatgaacaaagcggactatagcgcgaacagcctgcaggtttacggcgagctgggctataagtttaccgcgaacgcggtgatgatcgaaccgttcgttaacagcgcgtacgtgcacctgcgtaccaacgcgtttgaggaagacggtgatgcgagcaaggttagcggcaaacgtcaaagcgcgaacgtggttagcagcattctgggtgcgcgtatcagcaacattgtggagagcggtagcggtaccgcgttccgtctgagcggtatgatcggctggaactacaacgttggtgatatcgcgccgattgcgagcgtgaactatcgtggtggcaacacctttgacgttcgtggtattccgctgagccgtaacgcgttcgttaccgaagtgggtatccaggcgagcccgaagaaaaacctgagcgcgggcctgtactatgatggtcgttttggccgtaaggtgagcgaccacagcctgagcctgggtatcagctacgcgttccaccaccaccaccaccactaataagaattc

SEQ ID NO: 818 - DNA, 3662 bp, Artificial sequence; identical to SEQ ID NO: 817
  Optimized for E. Coli

SEQ ID NO: 819 - DNA, 4220 bp, Artificial sequence
  Optimized for E. Coli
ccatgggtttcgaggcggcgcgtgtgggcgacgatattggtcatagcggtgcgctggcgggtatgattgcgggcaccattgttggtggcctgattgcggcggcgggtggcattctggcgggtgcgatgtttattgcgggtctgggtgcgagctgcctgggtgtgggcgttctgctggttggtgcgagcctggcggttggttactataccggtgaactggcgaccgcggcgcgtgacagcatcgcggatgcgggtgcgagcagcatgaccaagaaaggtgtgatcaccagcggcagcccgaacgttttcattaacggcaagccggcggcgctggcgaccgacagcaccgtggattgcagcgacgatggtagccagcaaatggcggaaggcagcaagcgtgtttttatcaacagccagccggcgagccgtattggtgaccgtaccacctgcgatgcgaaagtgatgaccggcagcgacaacgttatcattggtggcgatccgcagcaaaccctgccgatccaaagcgaggtgccggaatggctgtacaaggttagcgacctgaccctgctgtttgcgggtctgctgggtggctggggtggcgcggcgggcaaagtgggtgcgctgagcaagctgctgggtaaaatcccgggcattaacaaactggcgcgtattgcgtgccgtgcgggtaccctgatgaccggcgttgcggcggcgggtatcattgcgcgtccggtggatatcgttagcggtcagaaattcctgagcggcgacgatgagctggactttgtgctgccgagccgtctgccggttcgttggcaacgttactggcgtagcggtaacccgggtgatagcgtgctgggtcgtggctggagcctgttctgggagagccgtctggaaccgtaccaggatggtctggtgtggcgtgcgccgagcggtgactatatcgcgtttccgaacgttccgaagggtatgcgtacctactgcgagagcgagaagaactggctggagcaccacagcgacgatagctggagcgtgtacgacgttagcggtgaacgttggcactatgcgccgctgaaggatgatgcgccgagcctgctgcagcgtatcagcgaaccgtgcggtaacgcgattctgttcgagtggaacgcgaacaacaccctgcatgcgctgaccgatagcgcgggtcaacgtgtggtttgccgttacgacagcgatcgtctggcgggtgcgtggctggatgatgagatttgcctggtgagctacgcgtatgacgaacagcgtcaactggtgtgcgttaccggtcgtggtggcagcgttcgtcgtcgtttccgttggcaggacggtctgatgagcgcgcacgaagatgcgaacggcctgctgagcgagtatcgttggcaggaaatcgacggtctgccgcgtgtggttggctttcgtcacagcggtggcgagcaactgaccttcgaatacgactttgataacggtacccgtcgtgcgacccgtgatgatggtgcgcaggcgcactggctggttgacgatgacgataacgttgcgcgtttcaccgactacgatggtcgtcaaaccacctttgtgtatcgtgacggcgagctgtgcgatgttattctgccgggtggcgcgatgcgtcgtagcacctgggataaatacggtcgtatgaccagcgaaaccgatccggcgggtcgtcgtaccgagtaccactggtatcgtctgaccgaccgtatcacccgtaccgtttacccggatggtaccagcagccaggcgatgtatgacctgcgtggtcgtctgctgagcgaaaccgacccggcgggtaacgcgaccgcgtacgactatccggacgatcaagagaacctgccggaaagcatcaccgacgcgattggtggcgtggttcgtctggtgtggaaccaccagggtctgctgacccaacgtaccgattgcagcggcagcgttacccgtttcacctacgaccgttttggtcagctgatcgcgagcgagaacgcggaaggcaacattacccgtcgtgaatggagccgtgcgggtctgctgagcgcggtgattcacccggatggcagccgtgagagcctggtttggaacgaacgtggtcaactgaccggttggcgtgacccgctggagagcgaagtgagctgggcgtataacgcgctgggtctgccggtgagcctgaccgatcgtatcggccgtgttcgtcaatggcgttacgatccgcgtggtaacctgctgcgtctggacaacggtaacggcgcggaataccgtttcacctatgatgcggtgggtcgtccgctgagcgaaacccgtccggacgataccgttcgtcacatggaatgggatgcgcgtggttttctgtgcgcgctggaggaaaacggccgtccggcggcggatggtggcattgcgcgtcgtgttcagcaattcagctacgacgatagcggtctgctgattggtcgtacccagcgtcatgcggagtaccgttattttcgtgacctgagcggtcaaatcacccgtattcgtcgtaccccgaccgcggaaggtgtggcgctgggtatcgagagcgacgaaattgtgtatcgtcacgatgcgaacggtcgtgttctgagcgagagcggtattaacggcgcggttggttacgaatgggatgcgctgagcaacctgaccggcctgaccctgccgggcgagcagaagctggcgtggctgcactatggtagcggccacgtgagcgcgatccgtttcggtcagcaactggttaccgaatttacccgtgaccgtctgcatcgtgaggtgcgtcgtacccagggtgcgcgtgaacagctgcgtcaatacgatagcctgggccgtcgtaccctgcaacgtagcgagctgagcaccgacgttaccctgccggagaaggcgctgctggaacgtctgtaccgttataccgcgcgtggtgaactgagcggcgtgagcgacaccctgcgtggcgaggttgactacggttatgatgcggaaggccgtctgctgaaacactatgaggcgcgtcagggtcacagccgtgcgcaattcagctatgatgcggcggataacctggcggcgagcgatgatgcggcgccggtgaccgataaccgtctgcagcactggcaagcgctgtttatgaagtatgaccactggggtaacctggtgagccgtcgtaacggcctgtacgaacagcactacgcgtatgatgcggagaaccgtctggttagcgcgcgtggtaccggtccggagggtcgtttcgaagcgcgttaccactatgacgcgctgggccgtcgtacccgtaaaatcgtgaccaccacccacggtaccaccgaaacccgttttctgtggcagggctatcgtctgctgcaagagcagcaagaaagcggtctgtgcaacacctacattaacgatccgaacgaggcgtggagcccgctggcgcgtgttgaccacctgcgtgatcagaacagcggtgaaatctattggttcaacaccgatctgaacggtgcgccgctggaagtgaccgacgaacgtggcgcggttcgttggagcggccagtacggtagcttcggcgaggtgcgccaccaaagcgaaggttttagccgtctggttaaccgtaccgcgatggcgcaccagccgctgcgttatgcgggtcaatatgcggatggtgaaaccggcctgcactataacctgttccgttactatgatccgcaggttggtcgttttatcgttcaagacccgattggcctgaacggtggctggaacctgtaccagtatgcgccgaacccgctgggttggattgacccgctgggcctgctgacctacaacaccatgccgagcattaccggtttccaaaaacaccacatcattccgcagcaactgaagggccacgatctgatcaaagcggcggactttaacatccacgatattaagaacgtgatttacctgccgaaaagcgcggactatcacccgacccgtaccatccacagcggtagccacccggtttataccaagaacatcggcgaccagatggatgcgatttacgagtatggcaaggaaaacggctggaaacaggcggagtacaagcaagcggtgagcgagatcattaaaaacgaacgtgcggacctgcgtggtggcaaaaccatcctgaacaagaacagcgttcgtaaagcgcgttgccaccaccaccaccaccactaataagaattc

SEQ ID NO: 820 - DNA, 1628 bp, Artificial sequence
  Optimized for E. Coli
ccatggacccggcgagccagcaactgcgtgatcagcaacaggcgcaacgtcagcgtgagcagctgcaacagctggaacgtctgcaacgtctgcagccgatcaccagccacgacgatcgtagcgcgttcaccgacaccagcgataactgctggagcattaccggtgtgcgtctgaccggcaaccaaaagctgccgacccaccaactgcagccgaccgttcaagcgctgagccagccgtgcatgggtatcgcgagcattaaccagctgctgaagggtctgacccaacagtatgtggaggcgggttatccgaccagccgtccgtacctggcgcgtccgccgaaacacgagcaaccgctggacatcgtgatcattgaaggtttcgttgagagcattgaactgaccgatggcgagctgccgctgagcctgcagggtgcgtttccgggtctgctgggcaaaccgctgcacctgccggacatcgaacaaggcctggatcagctgaaccgtctgcgtgcgtatgacctgggtattgaactgctgccgggtgaactgcagggtggcacccgtgtggttctgcaaccgcgtcaagtgaccagcccgtggcacctggacacccgtctggataaccgtggtagcgaactggttggccgtcaccgtctgaacctgggtctgggcctggacagcccgctgggtatgaacggcgatctgcgtctgagcatggcgagcaccgttttcaacgcgccgggtcagagccgtggcctgaacctgtactatagcctgccgtacggtccgtggacctttaccctgaacgcgagccgtatgagctatcgtgcgccggtgccggagagccacatcgttagcaacggcaagagccgtttcctgggtctgggtgcggaacgtctgctgtggcgtaaccaacgtggcattctgagcgcgagcgcgcgtgtggaccgtaaacaactgatcacccgtagcgatagcaccgttattagcctgcaaagcccgaccctggcgaccctggaggcgggtctgaacctgctgtggatcgaccgtggcctgtggaacgcgtacctgggtgtgagccaaggcatggactggtttggtgcggatcgtccgctgccgcaagcgcagaccccgcgtccggattttctgaagtaccgtgttaacctgctgcacctgcgtcagggtccgggtcactggccgtggcgttggcaaagcgagctgaccggccagtatagcgcggacgtgctgccggcggttgaacaattccagctgagcgacgatagcgcggtgcgtggttttcgtcaacacaccgcgagcggtgcgagcgcggcggtttggcgtaacaccctgagccaaccgctggacctggcgtggacccacagcgtgcaggttcgtccgaccgtgggtctggatctgggttggacccgttttgcgcgtgcgagcgcgagccaacgtctggcgggtgcggcggcgggcgttgagctgagcctgccgcaaagccgtctgcgtctggactaccagcgtgcgctgtatgcgagcgataagccggcgaaaggtctggaacgtggctattgggtgctggattggaccctgaccattcaccaccaccaccaccactaataagaattc

SEQ ID NO: 821 - DNA, 1628 bp, Artificial sequence; identical to SEQ ID NO: 820
  Optimized for E. Coli

SEQ ID NO: 822 - DNA, 3161 bp, Artificial sequence
  Optimized for E. Coli
ccatgggtaccattccggagcgtcgtctgctgccgaacgcggcggataagaccgcgctgaaagcgatcgcgaccagcattgtgcaaacctgcccgagcctgctggatgcggcgcgtcaggttgcgattgaactgctgaccgacaaaggcctgagcggtctggacccggatgaggtgtacttccaccgttttaagaccgcgcaaagcagcaccctgaccttcaccggttgggagcacctgctggaaaaaccgtatgaaaccctgaccctgacccaactggttatccaccgttttcgtgcgaccgaccaggataacgcggacctgctgggcctgtactgcggtttttatagcgacggtccggatgcggaaaacttcaaccaggacaacgaggttcgtctgctgggcagcgatgtgctgaaggcgttctgggcggttgactttagcacccgttacaccggtcaactgaccaaattctggcagaccagcagcgaagattttcgtgcgctggcgaagtgcaacttcctgagccaggcggtgcaagcgctgcaggaaggtgacgttgatggtaacgacttccagcgtatcgtgaccagcctgatcggcccgattacctggccgattaccctgcaaatgctgcgtgcgacctacccggtgggtgcgcaggttcgtaccctggacctggatggccacgtggcgaccaacgttctgcgtctggtggaagatagcggtcgtcaaaccctgtatctgccgggtgaaccgcaggcgttccgtctgatggacaccgcggcggatctgcactggtggctgctggaccaaatgaacagcgaacagaagcgtccgctgttcctgaaacactttagcctggcggatagcaaccacatcaccgagaacctgaccgacctgatgaaccgtctggtgagcacctggggtcacagcgatcaccgtatgatcaaccgtagcaacgttgcgattagcggtgacgcgttcacctggctgagcgaaagcacccgtgcgggtatggcggcggaggcgcacctggtgctgaccagcaacagcgatctgcgtaagaaactgtggaccggctacctgagcgcgggtctgaaagtttttggcccgatggcggcggttggttggccggttgcgctgccgctgattggtgcgggtattgcgaacatgggtctgaacatcgaccaggcgatcaacggtattaccgcggcggaacgtcgtgcgggcgttattggtgcggtgctgagcgcgattgaaaccgtgttcaacgttccgtttctgatcggcaccggtgcgcaactggaagttggtccgcaggtggagtatgcgggtgcggaggaaatgctgggcctgattgaactgagcagcgcggacaccccgagcctgccgccggttgacccgccgccggtgaccggtaccgaggcggcgaccagcgaactgaccaacgagattccggaggaagcgaccagcgtgaccgcgaccgaactgctgaccatgaccgcgacccgtcacggcccgaccttcccggaagtgccggcgagctaccgttgcaacgagctgctggcgcagcacagcgttgaagcgaccccgggcaagtacgagggtatctatcgtctggataaagaaccgggttacgcgattgagatggacggccaagcgtactatgttcgttattttgcggacagccaggatagcggtaactgggcgatcgtgaacccggaacgtccgaaccaatttgcgtatagcctgccggttcgtttcggcagcgcgggtaaatgggagcgtatgccggcgctgcgtctgcgtggtggcggtcaatgcgtgggtaaagcgtgcgcgccggaaaccgaggtgagcagcagcggcggtaccccgagcgttgaaatgcgttgcctggaaccgctgccgggcgttccgtgcccgctgcgtctggttaccaagctgaaaggtgtgagcgagaaggaaaaaccgggcatgcgtcgttgggcgatgaacctgccgagcgcgagcgcggagagcgcgggtgcgcgtcgtcgtttcctgagcaccaccgaacgttacgtggagcacttcagcgaggaacgtcgtgcgctgctgaacaaggcggaaaaattccaccgtgagctgaaatggatcaacctgccggaacgtccggatatcccgcaaattagcccgcagatgcaagtggacgatctgatcgaccgtatttttgcgaacaccgatggcctggcggttggtgaaaccctggaccgtatcgcgagcatgcgttttatgattgagaacatgccggcgttcgcgcgtcacattcagaccctgtacgtgcgtggtctgctgagcgacttcgcgcaaaacgatctgaaccagttctttctgagcggcgacatgagcgaggatctgcgtacctatctgagcggcctgggtaccgatccggaaaaccgttttaacgttctggagctggtgaagaccgcgcaagcgaacggtatccgtgttcacggcctggatgcggcgcacacctacaccctgaagcgtccgctgctgagcatcgaggaacagatgattaaaacccgtctgagcaccaccatcattgaaggtgacaagctgctgaaccgtaccaagaaatgggtggcgctggttgatgcgaccaacatcaacatgttccgtgacctgccgggtattagcgagctgcgtggcggtatcggcctgcgtattgaggaagtgtggccggaggaaaccgcggacatcagcattgatccgggtgtggaagttgcgcgtggcccgttttataactgggcgatgaccagcaacgcgttcgacgttctgtttgcggatctgcgtctgcaaatcaagagcccgatgccgcagtggaacgcggcggcgctggaaaaactgctgcaccgtaacggcatgttcgtgatccaaaagaccgagccggacatttacaccctggttcgtcgtaacagcgacagcgatattgttcgtacccgtgtgcactgcaccaccgcgggtcgtttttatatctgggatctgagcatgccgcgtattaccggccgtaacttccacgacatcgcggcggttgcggaacgtctgattgagctgggctttaccctgcagagccgtctgccgacccaccaccaccaccaccactaataagaattc

SEQ ID NO: 823 - DNA, 4685 bp, Artificial sequence
  Optimized for E. Coli
ccatgggcccgatcaagattgcgaccaagggtaacaccaccgtggacgttcacctgcgtccggacaccccggttgatccgccggcgctgcgtccggatatcaccctgcgtccgggcctggaggcggaaaccctgaccaccccgccgcgtccgggtagcaccaccggtagcgcggatgcggatgcgattggtctggcgccgaccgtgaccgttcacccgacccgtagcggtcaggatagcgttgacctgggtgatcgtagcctggaacactaccgtctgagcctgaccccgagcctgccggcggcgaacaccgagggcctgcgtctgttcaagggtcgtcagtatgtggaactggcggatggtggcctggtgcaggttggtaaagagagccaaagcggtctgtggcgtgcgaccctggcgagcgagctgaccccgaccggtccggcgatgctgcgtaacccggacgatggtctgtggcacgcgttcgaacacagccaaccgaccacctttgcgctgagcgcgacccgtctggaggacttccgtaccgcgctggattttagcagcgcgatcggcgacagcgatggtctgcaccgttttgaaggcaagctgtacgcggttattgacaaccacgcgtatcaggtgctgcaagacctggatgcgagcaccccgtggagccaggtgatgcgtatcgttcgtgcggaagacccggtggcggttgatgcggataaccactacgttgcgagccgtccgggtcgtagccaagcgattgtgctggatccgagcgaaggttgggtgggtgttagcaccggtggcgcgggtggcatgcgtcgtgcggaacgtaacccgagcgcgcgtcgtagcctggcggaacgtttctttgcgtttacccatcgtagcagccgtccggaggcgcgtgttcgtaaactgtacccgagcttcgacgatcagcaagttgcggcgtttctgcgtaccctgggtgacgatgtggacggtggcctgaccaccaaggaaaccgaatatagcaacctggaaaaagatctgcaggcgtggaccgcgacccataaacatctgaccgtgccgagcgcgcaaggtccggttaccaactgggcgaacaccgtggcgaacggtatcaaacgttgctggagccaggaaaccacccaactgcgttttccgctgagccatgcgccgctgccggcgctgcgtgcggacttcaaccacgttcgttttctggagatggatagcgtggcgtggagcccggcggcggaaaccttcctgagcggctttagcggtctgcagagcctgaagattacccgtagcggtctggaaaaactgccggcggcggtgagccagatgcacaacctgaccgaactgaacctgcgtaccaacaagctgcaactggacgaagcgagcgcggcggcgctgggtggcctggcgaacctggaagtgctggttctgaccaagaacccgctgggtaaactgccggacttcagcgcgatgccgaacctgcaggagctggatctgtgcgcgaccggtatcaagggttggccgaccggcctgaaaggtctgaccgcgctgaagaaaattgacctgcgtcacaacaaactgcaggaagtgccggcggaacacctgaacccggcggacgatcaattcgaagcgatcgtgcacattaaccgtcacatcctgctggagaacaacgcgtttccggcggattactggcagaacttcgagcgtttttggctgcaagcggaggcgcgtaaagcggaatgggcggcgggtgcgctggagggtgcgttccgtctgaaagaaggcatcggtgttattgaccgtacccgtaacctgtatgcgcacctggatgtggcgggcgcgaagaaattcatcatgggcctgggtgacgataccgacgcggttctgacccgtcgtagcgaagcgtttgcgcagctggacaccagcctggatgcgtacaagcaaagctgcgcgctgctgagcaacgcgggtcagcgtaaacgtgcgctggaaaccgcgaccgcgatccgtcagtgctggctggaccagacccaaaccaccctgaccctggattatctgggcctggtgggtattagcaacaagcaaaccatgctgccggacctgagcgcggatttcggccacgttcgtaaactgaccctgatcggtgtggaatggagcccggcggcgaacaccttcctgagcggtttcagccacctgcagcacctgagcattggtaacagcaccctggacaagccgccgaccatgctgagccagatgcaaaccctgacctggctgaacctgggcagcaaccagatcgagctggatgcgcaagcggttgcgaccattgcgggtctgaaccgtctgacccacctgaacctgagccacaacccgctgaagattaccccggatgtgagcgcgatgagcggcctgaccaccctgaacctgagccacgcgcagattagccactggccgctgggtctgctgaacaaaaccgcgctgaccggcgttgacctgggtagcaacctgctgaccgatgtgccggaggcgcacctgaacccgccggcggatcagctggcggcggtggcgcgtatcaacaacgttaccctgctgatcagcaacccgggcattccgagcagctacgttcgtaagttcgaaggttattggcgtcgtctgaacaccgcgcatccggagctgatgaccccggtgcacccgagcgcgtttgaccacgataaaagccgtgcgcagcgttaccaccgtctgtatccggcgaagagcatcaacgactgccgtaaatatctgtggggcctggaaccgggtaccgttggtacccgtctgagccaactggagcgtgagttcgcggttctgaaccagcaactggatgcgtgggtgtttagcggtggcggtaaccgtcagggttatattccggcgaaccaactgatgctgaacgcggagaaccgtgcggaccgtaccaccgcgcgtgatcgtatcattaactgctggcgtcaggaaaccccgcagcaaaccgcgttcgacggcaccagcatcggtctggagctggatctgagcggtctgaacctgccgagcctgccggacattgatgcggactttagccacgtgggcagcgttaaactgcgtgacatgcacctgagcgcgagcccggaaggtttcctgacccgttttcgtcacgttcgttggctggatctgagcaagaaccaactgcgtgttctgccgccggcgattggtcagatgaacggtctgaccaaactgttcctgcaacacaacgaaatcagcctgaccgtggacaccgcgcgtattctgagcgagcgtaccaccctgcgtgcgctgtggctgagcaacaaccgtcagctgggtatcgttccggacttcagccgtattccggatatgcgtagcgtgaacctggcgagcaccggcatcagcgaatttccggttggtctgagcgcgcaaccgagcctggacaccgtgaacctgagcaacaaccgtatcgagcagattccggacttcgtgtttgatgcggttccgttccaagtgaacgatgttaccaacattcgttttaaccagctgaacaaccaaagccgtgcgcgtctggttgagtatgcgggccgtctggcggcggcgggcatgttcatgagcggtcgtaacaacctgatcgacaccggtctgagcatgaacatgccgaacattcgtgcgctgctgctggataccatgacccgttggaccgtgggtctgccggcgaccgaagtggcgacccgtcgtcagcaatggcagaccgtgcgtgacgagcaaggcagcgatggtctgtttaacaccatcgatcgtctgctgagcgaaccggcgagccacccggacctgcagcgtcgtgtttggaacctgatcgatagcattaccgagaacaccgcgcaaagcgagcacctgcgtcgtgaagtgctggatcgtgcgggcgatccggcgtgctgcgaccgtgcggcgttcacctttaccaacctggaagttctgaccctggcgcacaaagcgcgtagccaggcgcgtgatgaggcgcagggcaagcaactgagcgcgctgagcaaagcgctgttccgtctgcacgaagtggacaaaatcgcgagcgcggatattgcgcaacgtgaagcgcgtattgcggcgagccgtaccccggaggaagcgcgtctgtttggtccgccgcgtgtgccggaggaaattgaagttcgtctgttctaccgttttcgtctgaaggatcgtctgcaactgccgggtcaaccggagcgtatgggttttgcgcgtctggcggatgttagcgaggcgcagctgaacgcggcgtacgaaaaggtgatcgcgcaggataacagcccggaggaatttcaagcgctggttgcgcgtgagttctggcaagaatttattacccacaaatatcgtagccagttcgaaacccaacgtgacccgtttcagacccgtcaagcgaccctggatgatgcgcacagcgcgagcgaactgagcttcgttgattacaaggcgcagagcatgagcctgcaagcggagctggcgatcaaagaggcggaactgattaccaccctgagccgtcaggagctgagcgaatatgcgatgcaaaacagcgaaaccgcggcggtggaaaccgaacaccaccaccaccaccactaataagaattc

SEQ ID NO: 824 - DNA, 452 bp, Artificial sequence
  Optimized for E. Coli
ccatgggtatgccgctgccggtggttccgagccagccgagcgtgaacccggatgtggttaacgttcaatactatcgtgactatgatcgtggtccgcgtcgtggctaccacaacggttaccgtggctatcgtgagccgcgtccgggttatcgtcaccacgatggctactggtttccgctggcggcgtttgcggcgggtgcggtgatcggtggcgcgattgcggcgccgaactatcgtccggcgccggtgtatcgtccggcgccggtttaccgcccggcgccggtgtaccgtccggcgccggttggtaacctgaacccgcgtcactatgactggtgcgcgggccgttaccgtagctatgatgcgtacagcaacaccttccagccgaactatggtccgcgtcgtcaatgcctgagcccgtactttcaccaccaccaccaccactaataagaattc

SEQ ID NO: 825 - DNA, 452 bp, Artificial sequence; identical to SEQ ID NO: 824
  Optimized for E. Coli

SEQ ID NO: 826 - DNA, 1337 bp, Artificial sequence
  Optimized for E. Coli
ccatgggtagcagcaccctgaagctgaacgatggtctgagcgacattggcagcatcattcactacggtatcagccagattccggttatcggtggcgtgctgagcaccatctttggcctgctgtggccgaccgataaagaggacatttggagcaccatcaaacaggaagttcaaagcctgattaacgaggatatccaggaagacgattggaaccgtctggttgcggcggtgagcgagctgcaagataaagtgagctttattaacgaccagctgatcaacgcgcaatacgataccgcgggtccggagctgatgaccgtggttgtggacatcattggtattgaggaaaacttcaagatcgaaggcaccaacttcaaatatgcgtttgcgccgctgttcgttgcggcggtgaacctgaagattgcgctgtacctggaaggtatcaaatatagcaacgatctgggcctgagccaggaccaagttaaccagctgaagagcctgctgcagaaagacgtgcaaagcagcaagagctacctgagcccgattaacagcgcgatcggtaacacctacctgaacaacatccaaacctattttagcgttaaactgtactatgaaaccagcgtgagcctgttcaacgagctgtggagcggcgattacgaagactataacgcgccggcgccgctggaaaactactatgttccggtgatggcggcgggtagcttttataagctgattagcctggatggccagaactttagcgttccgatggcgttcgcggaagtggcggacaacagcatgatgccgagcaccaacatcctgggtagcctgtaccaagaaccgaccagctacccggacggctacatcaacttcatcgatgtttacaccgacctgagcgtgagccaccgtaccaccggtctgatgttcacctgcagcggcagcgatgagcagtacgaaatgggtatgaccccgaacaacaacgacagctttaacgttggccaaaacaccatgagcattaacgtggagggtggtgagttcatcaaccaggttagcgtgcgtgcggatagctttgttagccaaatcgagttcaccaccaacctgaacaacacgatggtggcgggtcagcacccggatgatgacccgattcaagaagttaccctggtgagcccgttcagcatcaacagcatgtacgttgtgagcgacgttgcgggctatattcagagcagcggtcaccaaatgtgcggcatcgcgattagcgcgatctacaacaacgagctggcgatgcagtacgtgagcagcctgtataaaaacagccaccaccaccaccaccactaataagaattc

SEQ ID NO: 827 - DNA, 335 bp, Artificial sequence
  Optimized for E. Coli
ccatgggtagcaccaactatgtgatccagccgctggaaaccgtgaccgtttgggacgatgcggaaccgatcattccgaccgttaccaagagcgtgattgttaccaacaacggcgaaaccaaactggaagtggttaactactgggctccgccgagccacgtgttctatccggacaccacctactgggtggagccgaacgataccatcattgttcaagcgccggaacgtagcttttactattaccgtgtgaacgttaccaacagcgacgataccaaggttggtgcggcgatcgtggagattgttgaccaccaccaccaccaccactaataagaattc

SEQ ID NO: 828 - DNA, 4451 bp, Artificial sequence
  Optimized for E. Coli
ccatggcggaaatttgggcggcgcgtaaggacgatgagctgatccacaccagcgcgctggcggacattgcgagcgcggtggcggaagttgcggtgtatgcggtggcgaccgcggcggttagcgcggctgctgcggcggcggcgccggcgctggcgggcgttgcggtgctgggtgcggcggcgaccgcggcgagcggttgcgtgggtgcgggtctgattgttggttttgcgaccagcctgaccggcgtgggcgagcacattagcaacggttgcgacgcggttgcgaactggctgttcccgccgagcgttagcggcgtgatcctgaccggtagcccgaacgtgtttaccaacgcgaagccggcggcgcgtgcggcgggtcgtctgctgaccccggcggaaatcaaagcgctgccggcgccgcagccgccgcaaagcttttgggattatggtgcggagctgctggcggcgggtggcaacattctgagccaactgtggcaaccgggcgttgcgggtccgagccagccgagccaaccgctggaggaagacaagatcagctgcgataaacacccgctgccgcagtatctggcggaaggcagcagcaaggtgttcattaacggtcaaccggcggttcgtagcaacgaccgtagcacctgcgaggcgaaggttagcaccgatgtgagcaaaaacgttcagattggtggcggtaccgtggttgtgcgtgacatcaagagcggtaaactgccgggtattggtctggcgctgaccgtgctgccgctgctgctgggtaacccggcgaagctggttaaaaacctgccgtgcatgatcggcggtggcctggcggcggcgggcgtgaacgcgctgggtgaagcgattcatgcggcgttcaacccggtgcatgcggcgaccggtgcgaaagttctgaacgacgaggaagacctggatctgctgctgccggcgcgttttccgctgatctggcagcgtaactacaacagccgtaacggctatcaaggtctgttcggccacggttggcgtaccccgtttgaaatctgggtggacctgaacgaccgtgatggtgttattgagtgctgcctgcacgatgaaaccggtcgtgagctgcgttttccgctgccggaagttaaccaaccgagcttcagcgcgggtgaaggtctgatgtttcgtcgtggcgaggaaggtcaactgctgatcgcggacaccgatggtagcgtgtggcgtctgtttgtgccgctgccgcagaccccgagccgtctgcgtctggtgagcctgagcgacgaatacgataacgcgctgctgctgaactatgacgagcgtcaacgtctgagccacattgttgatagcgcgggcaccatgaccctgcgtctggaatacggtgacccgcgttttgacgatcgtgtgaccgcgctgcgtcacaacgatgagccgcgtgttcgttaccgttatgacggtggcggtgatctgcaccaggtgatcgacgcgggcggtctggttacccgtgagttccactacaacgcgcaacacctgctgacccgtcatcaacaagcgggcggtccgagctttgcgtatcgttgggcgatgtttgacgattggcgtgttgtggaacatcgtgatagcgcgggcggtggctgcaccattgactacgatctggcggcgggcctgaccaccgtgaccgagtatgacggtctgcgtcaccagcaccgctggaacgcgcaacgtctgatcgtggaatacaccgatgaacgtggtgaggtttggcactatcaatggaacgacgaggatatgctgatcgcgacccgtgacccgctgggccacggttggcacttccgttacgacgaagcgggtaacctggtggaggaagaggatccgctgggccacattcgtctgaccggttggctgccgcagcgtgcgctgccgattagcgttaaggagccgaacggtgcgacccaacacttttactatgacgaacgtcacgcgctgatcgcggagattgatgcgctgggccacacccagcgttacctgcgtgacggctatggtcaggttgtgcaagcggttgatgcgaacggtggcatcagccacttcgcgtatgatgaacatggtcagctgctgcgtgcgcgtgattgcagcggcaagcagaccctgtacaaatataccgcgcaaggttggctgagcgaagtgaccgatgcggcgggcgagcgtgttcactaccgttatgatgcggcgggccgtctgacccagctgcaacgtgcggaaggttggcaggaaaccctgagctggaacgcgcagggtcaactggaccgttaccaaggcgcggatggtcgtctgacccactatcgctacgatgctgctggccgtctgctggcgacccgtaacccgctggatggcgaggttgtgcgtcactatgatgcgcgtggtcgtctgaccgcgctgcgtaacgaaaacgcggagagctacctgttccactggaccgcgtgcaacctgctgcaggaagagatcggcctggacggtgtgagcacccgttaccgttatgatgaatgccgtcgtgttgtggagcgtcgttttgcggcgaacaccagcgcggcgttcagccactactttagccacgacggcgcgggtcagctggttagcaagcaaaccccggatggcgaaacccgttaccgttatagcccgctgggtcaactgctgcatgcggcgagctaccgtggtaacgcgtggcatgatgaaccgaccaccgcgcagagcgaggtgagctttgactatgatctgctgggtcgtgttacccgtgagcaaggcgcgaacggtaccctgcgttacgactatgatccgatgggtaaccgtacccaaaccaccctgccggatggtcgtaccctgcgtgcgctgtactatggcagcggtcacctgctgcaactggcgctggacgaaatcaccctgagcgagttcgagcgtgataacctgcaccgtgagctgagccgtacccagggtcgtctgaccagccgtgtgcactacgaccgtctgggccgtaaagatcgtcgtgaaatttttaacgacaaccgtcaacgtccggcgccggcgagcagcagccgtcagtggagctacgattatcaaaacaacctgacccgtgaagagcacaacgcgaacccgttcagctaccagcgttaccaatatgatgcgaccggccgtctgctgagccgtgatggtacccgtccggataccgaacgttaccgttatgacccggcgagcaacctgctggatgagggccagttccgtcaacgtcacaaccgtgttctgcactaccagggcattgactaccgttatgatgtgtttggccgtaccgttgagaagcgtaaaggtcactatcgttggcagtacctgtatgacgcggatcaccgtctgtgcgaagttgtgcgttacagccaacaccgtagcgaggcgcagcaacacgtgcacttccactatgacccgctgggtcgtcgtacccagaagcgtgtttggcagcaaagccaggatctgcgtcaaccggcgggcaaatgccagaccaccaccttcctgtgggaaggttttcgtctgctgcaagaaacccgtgacggcatgccgctgacctacgtgtatgcggatcagggtagctacgaaccgctggcgcgtattgatggtcatgcgccggcgcaagttttctattttcacaccgcgccgaacggtgaaccggagagcctgaccgacagcgatggcaccctgcgttggcagagccacagcagcgcgtggggtcgtatcaaatacgaagagaaccagcaagacctggattatagccaaaacctgcgtctgcagggccaatacctggaccgtgaaaccggtctgcactataacctgttccgttactatgacccggatattggccgttttacccagcacgatccgatcggtctggcgggtggcattaacctgtaccaatatgcgccgaacccgctgggttgggtggatccgtggggttggaagccgcgttgcgcggcgaccaaagcgaacgatcacaaccaggcggcgtttggtcgtcagtggcaaggccgtggtatttacaagggccgtgacagctggagcaacatcatgctgaaagagggtgatattgtttatggtggcgcgccgggtcagagcggtttctattttaacaaagcgaccctggatgcggcgggtggcagccgtgcgaaactgtgggaaagcctgcaggtgctgccgcacgagaagttcggttaccgtagcaaaatccaagcgtatcgtgttaagcgtgaaaccatcgcgggcaccggtaaagcgattagccaagacccgacccgttttggcgagggtggcggtacccaattctttctgagcaactacaagaccgttctggaaccgatcgataaaccgtttgagattggtctgcaccaccaccaccaccactaataagaattc

SEQ ID NO: 829 - DNA, 377 bp, Artificial sequence
  Optimized for E. Coli
ccatgggtagcgacctggaagtgaagatcggcgttaacccggcggatgtgcgttacaccgcgaacttcaaggtggcgccgaacgacggttacgttatgtatgagaaaaacaccccgatcattccggaaattggtgtgaacatcaccgttattaacaccggccgtgaggaaatggaagtgcactacgaatgggctccgccgtttggtggctggcagtgcgcgagcaccaccatcattccgccggatggtaaaccggtttatatcgcgcacccgagcaacgcgttctactatcaacgtatcattgcgtacaacaagaaagagagcaccgcgtttggcaactgcgaatatcaccaccaccaccaccactaataagaattc

SEQ ID NO: 830 - DNA, 1316 bp, Artificial sequence
  Optimized for E. Coli
ccatgggcaacaacgaatacatcgtgacgatggagaagaagaacaacattgaactgaagagcagcggtcgttataccctggacgatttctaccacgaccacgcgtatgcgtttaaagttgcgctgaccatcggtctgaagaaaattccgtacgttggcagcatcctgagcaccctggtgaagattctgtggccgaccggtgcgagcggtgaaagcctgcagaacctgtgggaaatggagcgtaacgagatccaaagcatgattgacgaagcgaccctgcacaccatcaacgatattctgaacggtatcgtgaacagcctgggcgacaagatcgcggatattaaccgtaccattgagaactatggcttcgcggcggcgaaagacgattacatcaacctgattagcaactatatcattggcctggaggaacagttcaagtttgaaagcgagggtagcgaatttatcgcgtacgcgaccatgccgctgctgagcattaccgttggtctgcaactgagctatctggcgttcggtctggacaacaaagcgaactttggcctggatagcgcggacatcgataagtgcagccgtaacatcgacgagatctacaaggatgtgaagaaatacatcgaaaagtacgcgaagtggagcgacagcgatagctacagcaacgcgaacagcgaaaacatctataacgaggttatgggtagccgtgcgttctgcgcgctgaacggctttgaacacatcgagatttggagcgaaatccagagccgtaaaagcctggacttcagcatcattagcaccagcgtgagctacagcgttgaggtgggtgtgctgaccccgaacatgacccgtatggcgaccgcggttgaagtgggtccgccgctgctgccggttatggtggatggtcaccgtaacaagatcgttaaaattgagggttgggatagcgtggaaatcaacagctatcgtcgtgttggttgcctgaagattacctacgagaacggtgacgtttatgatatgggcgtgaaaaccagcaacccggttagcatcagcctggacggcgagttcgttgataccgtgaaggtggttcagggtgacacctacgcgatcaactatattaaatttaccctgaccgatggtcgtaccatgagcgtgggcgagcagagcggcgacacccaactgctgggcttcgataaccacaccatcgcggcgatttttgttgacgaaggtagcagcgataagatcagctgcgttagcgtgagctgcattccgaaacaatacgaggaagagcaccaccaccaccaccactaataagaattc

SEQ ID NO: 831 - DNA, 1406 bp, Artificial sequence
  Optimized for E. Coli
ccatgggcaacagcgaaagcaacaccgcgctggacgttaccaacgtggttagcccgatgatgacccgtggcaagagcaaagtgccgctgccgcaatgggaatgggacaacgcgtgcgatatcaagtactggatgattaaactggcgggtttcatcccggaagtgggcgcgattctgagcaccatgctggaagtgtgctggccgagcaagaaagagaacgtttggcagcaaatcctgcacgaggtggaaaacatgattgaaaccagcaagctgaccatcattcaaggtgtgctgcgtggcttcatcaacgagatggaaggcaaagttacccacgtgcagtttatgctggaaacccatccgggtagccgtgaggcgcatgatgcgtatatgagcctggcgcgttacctgatcggtatggaggaacacttctgcagctttgacgatcgtaccaacctgcagattatgccgatgtataccgcgagcctgatgctgcaagttatgtactggagcatcggcgtgcacaagagccaggaaatgggtctgaccgcgcgtgaggttgaggaaatgcaagacatcattgatcgtctggtggaccgtagcagcgcgtattgccacgcgctgtatgacaccgagtacgatgaaatcattaacaccagcgacgcgtacgatatcaccaacgatctgctgagcgttcgtggtcactgcctgatgcacggcattgaggttctggaaatcgtggagcagattaaggcgcgtggcagcaaagaaaacatcattctgaagaccctgagctatagcgaggttttcgaccgtgtgaccccgaagaccaaactgcaagcgctgaccgaagacgataacatggttgcgccgctgaaaccggcgtggctgggtaacaactatgcgcagattcgtagcctggttggttacattgttcgtattggtggcgcgccgcgtgtgggtggcctgggtatcacctttaccgatggcaacacctatcagctgggtaccattacccgtgaataccgtaacctggagctgaacggtagcgttatcaccctgattgaaacctggggtagcggtgcgattgatgaggcgctgttcaccctgagcgatggccgtaccttcagctttggtcaacgttacagctataactaccgtcgttttgaagcgccgggtcactatattaccggcctgtatctggcgagcgatgagccgagcctgcgtggtcaggcggcgggtatcatggcgagctaccacctgcgtaacgatccggcgaccccgagcaccccggttagcagcgtgccgcgtccgctgaaaagcctgccgcgtcgtgttgcggttagcgtgagcgcgcacggtgaaggccgtacccgtgaccaccaccaccaccaccactaataagaattc

SEQ ID NO: 832 - DNA, 452 bp, Artificial sequence
  Optimized for E. Coli
ccatgggtaccatcagcattaccgtgagcgttagccacaacgacgtggagttcgatggtggcaagctggatcgtctgcgtcacggtgcggcgattgcggcggatgatcacaccgcgcgtgttaccgagggcgaaatgcgtattgaaccgcgtagcagcctgcaggcgacccgtaccgataccccgatcattccggaaagccgtggtcgtttctacgtggcgaacgcgggcaaggcgaaacaagtgaccgcggtgttctactggagccacagcttcaccagcgagtggtttgaatatagcagcaccgtgatcgcgcgtggtaccgacggcattgttatgccgccaagcaacagcctgtactacagcaagatcgttatctacaacgataccgacgatgtggcgtttgttaccgcgtataccctgcaccaccaccaccaccactaataagaattc

SEQ ID NO: 833 - DNA, 1388 bp, Artificial sequence
  Optimized for E. Coli
ccatgggcaccaccaccatcattagcaccaagaaaaacggcccgggtctgcgtcacggtcacgttagcaccccggaaagccgtgcgtacttcgcgtggcaggaaggtcgtctgaacagcggtcagctgaaccaacgtgaagcgggcaagttctttccggcgaccgcgagcggtctgaccgacagcgtggcgccgaccgatagcaccaacatgctgccgccgccggatggtaaaattgcgagcgcgaaccaaggcgacggtgaatttctggatgagccgggtacccactggaagaaacacagcgttgaaagcgcggagctgctgaaggtgacctggtactatagcgcgccgcacgcgacccgtcgttggaactacttcattacccgtgagggctggaacccgaacatgccgctgagccgtgcgcagttcgaagacaagccgttttataaagttgagctggaggaacaaccgttttggagccacgcggcggcgctgaacccgccgaacccgaccgaacacctggttatgctgccgcagcgtagcggttaccacgtgctgctggcggtgtgggaagtggcgaacaccggcaacgcgttctatcaagtgatcgacctggattttattggtgatgttagcccgaccaccccggtggcgccgggtggcctgcgtgcgagcgcgagcaccaccagcagcatcaccctgaagtggaacgcggcggcgagcgcggcggaataccgtctgtatcgtaacaacaccctgatttacagcggcgaccagctgagcttcaccgataacggtctgccggagaacaccacctacagctatgcggtgagcagcgttaacgaggcggaagttgagagcgcgtttagccaaccgatcaccgcgagcaccagcagcgatgtgaacccggataccccgccgaccgcgccgacccacctgcacagcatgggcattaccaccaacagcgttagcctgatgtggggtgcgagcagcagcagcgttaaactgaacggctacctggtgtatcgtgacggtaacgaaatcgcgcgtgtgaacgttgcgcagctgagctataccgataccggtctgcgtccggcgaccgcgtaccgttatttcgtggttgcggaggatattcagggccaactgagcggtaccagcaacgtgctgagcgttagcaccgacaaggatgaagacgatagcggtggcggtacctacccgcactggatcctgggcgaaacctatcacgcgggtgacattgtgagccacaacggcaaaaactgggtgagctacgttacccatgtggcgcacagcccggattgggcgccgggtctggcgctgagcctgtggtatgaactgatccaccaccaccaccaccactaataagaattc

SEQ ID NO: 834 - DNA, 3005 bp, Artificial sequence
  Optimized for E. Coli
ccatgggtcagaacaacgataagattccgcaggtggttctgccgaccccgcaggcgcaactgtacgaaaaatatgtgaaccacccgaccgttgagtacaccggcaccccggaaatcaccattccgctgtatgagatcaccgttaagggtctgaaaatcccgattagcctgagctatcacgcgggtggcattaagtacggccagttcgacggtgatattggtgcgggttggaccctgagcaccggtggctatcgtgtgagccgtaccgtttacggtcagccggacgagcaatacgacatgtatgatccgaacgaactggaggaaatgtggaaccgtccgtggaccggcgatatccgtaagaaaattgagcgtgacacctacttcatgggtctggagcgtaagctgcaccaagaagcgtatgttcgtacccaggacagccaacacgacctgttcaactacatcctgccgaccaccaccggccagtatatcattagcgataagcgtaacaaaaccgtggttaccgacaagcaaaacggtgataaaatcattctggacgaaggtggcagcctgagcctgaacagcatgaaaatcattgacaccggtggcttcacctacctgctgggtggccagcaaaccaacccgagcgcgctgctggttgaaaccaccctgattccgggcaccagcgcgagcttcgcggataaggcgggttggccgctgcgtcagattcaaagcccgtacggtggcaacatcgactttacctacaaactgtatgagctgccgagcgaaaaccgtttcggtggcagctttaccctgaccgatgcgagctactttattgcgagcgcggcgaccggtccgcagtatagcaccgcgagcggcagcgttagcctgagcaacggtcgttacaagcaatactatatcgagaagattaccaccgacaaagaaaccatcattttcaaacgtctgggctttagcgttccgggtgttagcccggcgaacacccatgcgctgagcgagatcgaaattcgtgcgaaagataacaccctggtgaagaaaatcatcttcaaccacaagaaaagcccggaaggcaacaccaccattgacggtttttggcacatgctgctgaccagcgttagcatcagcaacggtaccggcgagccgcagacctacagcttcgcgtataacgaaccgaccctgagcagcccggtgtacgcggatcaatggggctactataagaacgcgtatgaaggtcgtccgggtggccgtatcatttggaacaagctgttcctgcacaaagagtttgcggacgaagttctgatgccgtggaccaacccgaaccacagctacgagccgaccccgctgaaatacgtgtggaacggcacctatccgggtaccgcgagctacaactttgttgatcgtagcaacaacagcagcgcgggcctgcacttctttagcctgagccgtattacctacccgaccaagggtagcatcgagtacgcgtatcagccgaacaaatatgaggcgggtggcgaaaccattagcggtagcggccaacgtgtgtggaagatcattagcaacaccgaggacggcaaaccgagcatcgttaccgaatacacctatggcaagaacggtgatggcctgggtagcgtgagcagcagcgcgtacctgagcgaccgtttctttgcgaccaccaccatcctgagcgaaatcattagcagcgatgtgaccctggttagcagcaacaaattcagccaagtgcgtacctacagcagcagcccgtatcaagcggacctgctggatctgatgaccgtggtttacccggaagtgaccaccagccagtatgacaccagcagccgtagctacaacggcaagatcgtgagcacctatcacatcccgttcaaaattggctgcagcagcattggtggcaccagcatccagctgggtaactacccgccgccgaccaagtactggaacgattactacatcaacatctacaacttcggcaaccaaccgtacctgaaaagccgtgttacctataacaacagcaacctgccgctgattcgtgaaagcttcgagtacgaaaacctgaagagccagatctttaaaggtatccgtgcgattcagaagcaaagctgcgtggaccgtccggttttcctgtactatgagctgtacgaaagcccgtacacctatatcgatccgatgtgcatcgcggaccgtattgaaaccaccctgaacttcaaccgtattaagagcaaagaggtggttagctttgaaggtagcgatagcatcaaagtgaccgaaacctaccagtatgacgcgctgaaccgtgtgacccgtagcgttaccaccaacggcattggtagcacccgtcagatcgagtacacctatccgagcagcggccaactggtgaccaagaacaaaatcggtgaaccggttcgtaccaagaccatcaacaacaacattccgaccggcatcgttgagaaaacctacccgctgaacgcgattaacccgagcagcctgcgtagcagcaccggtaacgaaagcaccctgcgtaccgatatcacctacaaccagtatgacagcaagggcaacctgctgcaatacacccgtgcggacggtaccattgtgagctatctgtggagctacaactatcagtacccggtggcggagatcgttaacgcgagctacaccaccgtgaccaacaacctgagcggcgttaccgcggcgagcctggcgggtaacgcgaacccggacgataccgtgctgagcgcggttaaggcgctgcgtaccctgctgaccaacgcggaagtgaccgtttataaataccgtccgctggttggtatcattgaacacaccgatccgcagggtatcagcacctggtatgactacgacgatctgggccgtctgcgtgaaacctgcttcaaggaatttggtatcaaacgtattctggagagctatgactacaactatcgtaaccaacaccaccaccaccaccactaataagaattc

SEQ ID NO: 835 - DNA, 3005 bp, Artificial sequence; identical to SEQ ID NO: 834
  Optimized for E. Coli

SEQ ID NO: 836 - DNA, 512 bp, Artificial sequence
  Optimized for E. Coli
ccatgggtcaggaagacacctaccgtggtgatggcctgaacctgtacgcgtattgcgcgaacaacccggtgacctatttcgacccgagcggtaacaacggcctgctgaactgcccgcaaccgggttttgcgccgggtaacggcgacccggaaaccctgtaccactataccaacgaaaagggcaaagatgcgatcctggagagccaggaactgttcccgagcctgaaggcgaacaacccgaaagacgcgcgttacggtaacggccaatatctgagcgatattaacccgaccaccaccaagccggcgagcctggcgagcaaattcatccgtaccccgaacaagtacaaatatacccactttgtggaaattgacgttagcgatctgaacgtggttcgtggtcgtgacggcgtgtttgttatcccgaacaacaacagcctggatatcagcggccgtattgtgagcagcggcaaggttggcagccagcaccaccaccaccaccactaataagaattc

SEQ ID NO: 837 - DNA, 2129 bp, Artificial sequence
  Optimized for E. Coli
ccatggaggaaaccagcaccgtggacaccagcagcaccgaacagaccagccaaccggcgaccagcgaggtggaagacagcacccaggttagcagcaccgatcaagtgaccaccccgagcattcatgtgagcgaaccggcggcgagcgaggaaccgaccgagccgagcaacgagccggaacaggaagtgaccagcgaggcgccgaagatcagcgcgctggcggcggtgggtgatggtaccgaagcgaacccgtaccgtgttaccaccttccaagagctgaaagatgcgctgggtaccctggttgcggcgggtcagacccaatacatccagctgcaaaacgatattgtgtataacgcgaccggtatcagcattacccagaacaccgttattgacggtaacggcaacgcgctgctgtacagcggcaccacctatgatccggcgcaattccgtaccggtgcgaacaacatcagcattacctacaagaacctgagctttggcaacagcacctatccgaacagcacctggtacggtatcctgtataccggtaacagcggcgtgaacttcaccgttgaaaacatcaactacaccattaaaaacggcaaccagccgttttggggtaacaacggtagcggcaacaagctgaccttcaagggcaaaaacaacttttacagcagcggtagcagctatggtggtgagttcgtggagggttatccgaccgtggtttttgcggaagacagcgaaaccaccgtgtacaacgatagcccgaacgcgaccggcgttttctatagcaccggtcagagcgtgaccgttgaaaaacgtgcgagcgtgagcattgagagcagcaaggactacctgttctataacagcgcgaccctgaacgttcaggagcagggcaagtttagctacaaaaccatccgtggtaccaactatagcagcaacaccgcgaccctgtgcgtgggtaccctgaccgcgaactttgcgaacgacagcattggccacttcaccaccgatgtgaacagctttaccggtagcaacccgatcgttaacctgaacagcccggactacgtggttttcgatgcgaccagcagcagcaagaaagttatcgacaccatgaacccgatttttaaacgtaccgacagcgataccagcctgtacaagatcgcgtatctgaccgcgagcggccagaacacctacgtgccgaaggttaacagcggtagcagctataccgtgaccagcagcaacatcggtaacggctacagcgttgcgtatgcgaaaatgccgagcattgaagcgccggcggtgaccgcggcgaccggtccggatatcagcaacattgcggcgcaaatcaacaacgcggcgccggcgaccaccctgagcagcaaggttcagtacaaactggcgaacaagcaactgtatagcggcgacctggcggcggatgcggcgcagagcagcattgaacaagcggaaaccgcggacgatggtatcattgaaaagaaagagctggcgctgccgggtgatggcctgccgatcggcgacgataccaaacacaccttcgttcacctgccgccgggtaactaccacgtgtatgcgaagaccaacgatcagcgtgttgcgggctacacctttgagagcctgtggaaagaaagcaccgcggaagtgcaaccgttcatccaggtgcaatttagcagcaacgcgatgagcttcaacagcccgattccgggccagtttggcaagcagcaaaacctggacaactataccatccgtaacgcgggtaacgtgccgaccaacatcaacctgaccagcattacccgtaacagcgacagcagcgaaaaactgagcctggttgagcagttcgataccaacaaccaagaactgctgctgagcctgatcgcggagaaagcgggtagcggtacccgtaccacctttggtccgctggttgacaaggatccgctgagcctggacaccctgcagctggatccgttttgggaagcggacgcgcaagcggatctgtacctggcgggtgattatagcggcccgatgatcggtccgcagaacttcagctaccgtttcagctttgcgattagcgcggttaccaccaaccaccaccaccaccaccactaataagaattc

SEQ ID NO: 838 - DNA, 2129 bp, Artificial sequence; identical to SEQ ID NO: 837
  Optimized for E. Coli

SEQ ID NO: 839 - DNA, 701 bp, Artificial sequence
  Optimized for E. Coli
ccatgggtttccgtctgtacgaggaatttaaaaccatcgaggaaggtaaaacctggggcgagaaatactatatggcgtggtgcaagcgtatcattgacgatccgaaagtgctgacctgcaaccaccaagacaaggcgaacccggacaacgattacagcttcaccgaaaccaaactgagcatctttcacgcgtatatgggcaacagcgcgaagcaattcattaacccgagcctgcgtaaccagtgcatcaccgagttcgaaaacttttacattagcaacctggcggagagcctggacctggcgccgaaactggatcgtaacatcgtggtttatcgtttcgtgaaccgtgatatcgcggagcagattgaaaagagcagccgtttcaacaagtttaccgaaaaaggttttctgagcaccagcctgaccaagaaccgtagccgtaaatacgacaccgatctggttctgctgaaaatctacctgaagaaaggtagcatcggcgcgtatattgagccgctggacaaccgtggtctggagcaagagttcctgattcagaagggcagcaaactgtggaagaaaaagaaaatcaagcagcaacagctgattgcgaccagcctgctgaacagcccgagctttaagatcgatctgctggaatgctattgcattaccaacaaacaccaccaccaccaccactaataagaattc

SEQ ID NO: 840 - DNA, 1250 bp, Artificial sequence
  Optimized for E. Coli
ccatgggcacccaaatcagcgcgctgcacctggcggcggagagcacccagccgccgctgcacatgctgaccctgcaagcgctgaacatgattccgccggcgagcttcagcgcgagcgcgatgagcccgcaaggtatcgcgaccaccattctgagcatggtgctgaagctggtttacaagaaaatgaccgagccgaaagaagtggacgttatcggtatcattcaggaaaccctgatgaagaacaccagcgaatggctggagagcgaatatcaagcggttcgtaaagacgcggagagcctgcaggatgcgattagcagctggcaaaacagcccgaccgaggaagcgcgtcagctgatcgtggttcgtaacgaaattgcggtggcggatatgcgtcgtctgtgcatcctgagcattaacaccgcgaaaagccgtggcatcgtgcgtctgtgcggtgtttgcgcgctgagctgcctgctgtacttctttaccctgcgtgacaccctggtgtttggcaagagctggggttacgcgagcgatgttctggagaagtatagcaaagcgctgaccgaacaggcggacatcatgttcaaggatgtgctgaccgcggagattaacaactacaccgaaaacgacgatttttatgacccggagagccaggcgaaacgtagcgttatctactggaccagcggctataccaacattcaagaacacctgacctacggtgcgcagcaaaaaccgacccgtgtgtgcccggagcgtagcgacatcagcgcgaacccggtggatggcgaaaaccacaccgtttacctgggtaacctgttcctgaccgacagcaacagcagcgcggatggtagctacaactatctgagcgcggcggagccgcgtagctatgatcgtagcggcgatccggtgcgtctgccggttcgtagcgcgggtctgtaccacatccgtctgtactatgcgtatatgaccaacagcctgagctttgattacgaaacccagctgaagattgaacaagcgggcaaaatcattaccgacgcgcacctgaccgatctgaccaagaccgtgctgaccccgtataaaagcggcagcaactacggtccggttatctatcgtgaaacccagctgcacctggaggaaggtgacattgtgctgaccttccacgaggatcgtagcctgagcggtggcggtctgctgcaacacgttgaatttgtgaaagttcaccaccaccaccaccactaataagaattc

SEQ ID NO: 841 - DNA, 2825 bp, Artificial sequence
  Optimized for E. Coli
ccatgggtatcaccccgcagatcagcaacattcacgcgggcaccccgaccattaccgcgttcgacaaccgtcactttaccgtgcgtaccctgcagtactatcgtcaaccgaacatccagcaagatgttcaggagcgtctggagttccactattttaacatttacggtttcctgcagaagaacgcggatgcgcgtctgagcgagagcggtcaagacaacttctactatcacgcggatctgatgggctttagcctgctgaacaaaggtgtggacagcggcgagatctatcagctgaacgatattgaacaacgtctgatggttagcatcgacgcgaacaagacctttaaatggtgctgctacgaggcgaacgatagcctgggtcgtctggaaagcgtgagcgagaagattgaaggtggcaactggcgtgttagcgagcgtttccagtacgcgggcaacagccacaccgaacagctggcgaacctggcgggtcaatgcatcagccactttgacaccgcgggcctgctgcagacccaagaggtgagcctgcagggtgaaccgaccctgctgacccgtcaattcattcagcaagtggacaacgcggagtttaacgttgattggcaggaagacagcgatctgaccgcgctgagcccggagaaattcagccaccaaacccactttgacgcggcgggtgcgtgcctgagcatcattgatgcgaagggccacaaacagcaacgtgaatacgacatcaccggtcagctgattcgtaccaccttcaccgtgaagggccaggatacccaaccgatcacccagatcattgagtatagcgcggtgggtcaaaaagttcgtgaaatttacggtaacggcgcggtgaccgagtatgtttacgaagcgcagacccaacgtctgatcctgattcagacctatcgtccggttaaccacagcctgggttacaagctgttccaaagcctgcactatgactacgatccggtgggcaacgttatcgcgatttacaacagcgcggagaagaaagtgttttggcgtaaccagaaggttgaaccgaaacaccgttatcagtacgacaccctgtatcaactggtgcatgcgaccggtcgtgagattgcgggcattagccagcaaagccactacctgccgcaccacagcagcatcgacaacagcgtttatacccgttacttccgtgcgtatagctacgataagggtggcaacctgatccagattcatcatcgtgcgccggcgatgcagcaagcgtacaccatcaaaatgaccaccagcagccgtagcaaccatgcggtgctggcggatctggcggagttcccgcaccaagttgaaccgctgtttaccccgagcggtcagcaaaagcagctgctgcaaggcaaaaacctgacctggaccagccgtcaggagctgcaaagcgtgaacggtgcgggtggcaacgaattttatcgttacgacggcgatagccagcgtgcgctgaagatcacccaatataaccagaagcaaagcaaagtggtttacctgccgaacctggaaatccgtcagattgagcacaacgaaaagtaccacgttatctgcattggcgaggacagcgaagtgcaggcgcaagttctgcactgggagatcggcctgccggataaaatggtgaacaacaccgttcgttatagcattaacggtctgaccagcaacagcggcctggaactggacatggatggtaacctgatcagccaggaagagttctacccgtttggtggcaccgcggtgtggaccgttagcagcgcgctggaagtgaactataaaacccgtcgttacagcggtcaggaacgtgacatcaccggtctgtactattacggccgtcgttattaccaaccgtgggttggccgttggctgagcgcggacccggcgggtaccattgatggcctgaacctgtatcgtatggttcgtaacaacccgctgacctaccaggatgagcacggtctggcgccgcgtctgttcgacacccaagacgatatgttcgcggattttcagcaaaccgtgagcaagctgctgaacgcgagcagcaagatcgaacgtattgcgaaaaacccgagcctgatccgtaaccgtgttattagcatggcgcagctgttctataaggacaaaaccagcaaatttacctatgcgatcaacctgtacgagttcctggaaatggatagccagagcgaggaatttaagacctgggcgaccaacaaactgagctaccaaaacaccagccgtcagcgtcaaccgggttgggaaaccgtgaaccacgcggaacaggcgctgatccgtaccctgaccgcgcacgacagcttcaacattagcaacctgatcattagccagaaggcgaaactgtgcagcagctgcgagaacgcgatgtacaccttccgtcaaagcatgccgaagcgtcgttttaccaccatgattctgcgtgatggtgatctgccgctggcggcgattcagcacggccaaagccgtacccgttataaaaacagcagctacagcgcgggtgtggcggttggcaagaccagcttcaccctgtatgactacaaagatatcgagttccaggttggtatgggcaacttttggggtggcatggacaagaccctgtataccatgtacgcgaacgagttcgaacgtgtgtttggtaacctgccgattggtaaaggcgttaagaaaagctttccgccgaagccgccgaaaagcagcggtggccgtggtcaccagctggataaaaaccaaccgagcaccagccgtcgtcaccgtcaccaccaccaccaccactaataagaattc

SEQ ID NO: 842 - DNA, 1592 bp, Artificial sequence
  Optimized for E. Coli
ccatgggtaacatcaagatcttcaagttcatcgacatttacaccaacggcatcttcgttgagtttaacaacaaggaaaacaaactgctgagcattaacctgctgctgaacgacgagatcattgaaaagaccgaaaccaccggcgagagccacctgttcagcatcgataaaagcggccactaccgtgtggaaattagcctggaggcggaaaacaccgcgaacatccagagcaaggagatctattttcacattagcgagggtgaacgtaaaaacaagatcaaaaccaccaccaaggaaaaaaccattaaccagaagatcgcgggcattagcaactactatctggacattaaagcgaagaaaaagaactacgacaagatcaaacaagatctgaccttctatagcaagctgccgaccctggagctgaaacgtagcctgatctacgacaccctgaacgaatacgattatttcacctttcacggtgatggcaagtttgaaatcctggttgaactggcggagcaaattgaaagcctggactacgttgagtattgcagcgtgaccccggataccaccggttatctggcgccggagctgccggtgaacccggaacagctggacgatatcaaaagcgaaagcgacgatttcattaccccggattttaccccgcgtcaaacctacctggacgcgccgaagggcatgaacatccgtgatgcgtgggcgaaaaacattaacggtagcagcgcggtggttcgtcacctggacttcggcgtttatcgtaaccacgaggacctgatcgatagcaacattgtggttgtgaacagccgtccggagagcgaagattgcaaccacggtaccgcgagcaccggttgcattgttgcgaccctgaacaagttcggtgtgaccggcattgcgcaccactgccagttctacttttatgacaccggtgacctggatctgatcgttaaccacgtgcagccgggcgacatcgttagcctggatattcaatttagcgtgggtggcaaactgctgccggcgaccgcgatccgttcctggtgggaacgtatgaagatcattgttgacaaaggtgcgaccgtgattctggcggcgggtaacggtggcctggatctgagcgagccgggtgttatgcaggacttcggtgatagcggcagcatcctggtgggtgcgtgcaaccaccaaaacggcacccgtgcgtacttcagcaactataacccggaagtggcgtttgtgaacagctggggtgactggagcgtgaccaccaccggttacggcagcctgcagaagctgccgggcaacaaccgtaactacagcaacaactatagcggtaccagcagcgcgaccccgctgtgcagcggtgcgctggcgctgattcaggattatgcgaaaaagcaaggtgcgatcctgagcccgtggcaaatgcgtaccgttattgcggcgagcaactacaccgaaggtgtgagccacggtatcggctgccgtccgaacgttgactacctgttcggcattgtggatagcatcattcgtaaaagcgacctgccggagagcgcgcaccaccaccaccaccactaataagaattc

SEQ ID NO: 843 - DNA, 1592 bp, Artificial sequence
  Optimized for E. Coli
ccatgggtaatattaaaattttcaaattcattgatatttataccaatgggatttttgttgaattcaataataaagaaaataaattattatcaattaatttgcttttaaatgatgaaatcatagaaaaaaccgaaaccacaggtgaaagtcatttattttctatcgataaatcaggtcactatcgtgtagagattagcctggaggctgaaaacacagcaaacatccaatcaaaggaaatttattttcatatcagcgaaggtgaaagaaaaaacaaaattaaaaccaccactaaagaaaaaacaatcaatcaaaaaatagctggtatttctaattattatttagatataaaagcaaaaaagaaaaattatgataaaataaaacaagatttaactttttactcaaagctcccgactttagaattaaaaaggtcattaatttatgacacattaaatgaatatgattattttacgttccatggagacggtaaatttgaaatcttagttgagctagcggaacaaatagagagtttagattatgtcgagtattgttccgtcactccagataccacagggtatctggccccagaactgcccgtaaaccctgagcaacttgacgatattaaaagcgaaagtgacgattttattacccctgattttacaccaagacaaacttaccttgatgcgcccaaagggatgaacatccgcgatgcatgggcaaaaaatattaatggttcatccgcagtcgtacgtcacttagactttggtgtctaccgaaaccatgaggatttaatcgactcaaatatcgttgtggtgaatagccgcccagaaagtgaagactgtaatcatggcactgcatcaacaggctgtatcgtagcaacgctcaataaatttggtgttacaggtattgcccatcactgccaattttacttctatgacacaggtgacctagatttaatcgtcaatcatgtgcagcctggtgatattgtcagcctagatatacagtttagtgttggaggaaaactgctccctgccactgcaatacgtagctggtgggaacgtatgaaaattatcgtggataaaggtgcaacagttatccttgcggcgggcaatggcggattggatttaagtgaacctggcgtgatgcaggatttcggtgatagtggcagtattttagtgggtgcttgtaaccaccaaaacggaacacgagcttatttctcgaactataacccagaagttgcctttgtgaattcttggggagactggagtgtcaccacaacaggttatggctcattacaaaaattaccagggaacaaccgcaattattcaaataattattcgggtacatccagcgctacaccattatgctcaggtgcattagcgttaattcaagattacgcgaaaaaacaaggggcaatattatctccgtggcaaatgcgtaccgttattgctgcatcaaattatactgaaggtgtatcacacggcattggttgtcgacccaatgtagattacttgtttggtatcgttgatagcatcatccgcaagtcagacttacccgaaagcgcgcaccaccaccaccaccactaataagaattc

SEQ ID NO: 844 - DNA, 2093 bp, Artificial sequence
  Optimized for E. Coli
ccatgggtcagatcacctacctggacgatctgccgaccctgggcagcaacgcgttccagtttgagggtacccaaagcggtgacagcaccgagcgtttcctggcggaatatggtcaaaacgcggcgaactttgtgagcgaggaaaagaaacagaagaaactggcggacatggcgcaagattacgcgcgtcacaaagcggcgaacatcgcgaccgatgagattacccagtggctgagcaaggcgggcaacacccgtctgaacatcaacctgaacgaaaaactgagcattaagaccagccaactggactggctggtgccgtggtatgaccagcacgatttcctgctgtttagccaacacagcattcaccgtaccgatggtcgtctgcagagcaacaacggtatcggcctgcgtcacttccaccaaaacagcatggttggcattaacgcgttctttgaccacgatctgagccactaccacagccgtctgggtctgggcctggaatacgcgcaggactatgcgcgtgtgagcaccaacagctatctgggtctgagcacctggcgtagcgcgagcgagctggcgtacaactactatgttcgtccggcgaacggttgggatatccaactggaaggctggctgccggcgtacagcaacctgggtgcgaacctgaaactggagcagtactatggtgacgatgtggcgctgttcggcaccaacgaacgtcaaaagaacccgatggcggcgaccgtgggcgttaactggagcccgtttccgctgctggcgctgaacgttgagcaccgtattggtaacaacggcgcgaacgaaaccggtgcgaaaatcgcgttcaactggctgctgggccgtagcctggagcagcacctggacaccagcgtgatcgaagcgaaccgtcacattccgaacaaccgttatgattttgtgaaccgtaacaacaacatcgttctggagtaccagaagaaaaccctgatcagcctgagcctgccgaaagtgattcaaggtgttaccggcgaggaacgtagcatcattcgtaacctgaccaccaaatatccgatcgagaagattgttgttgatgcgccggaactgattgcggcgggtggccgtctgcacctgaacggtattgatagcagcgtgaaactgccgagctacaagatcaccaacaacgcgctgaaaaaccagcaactgaacctgtaccgtctgaccgtgaccgtttatgacaccaagggcaacgtgagcccgcaggttgaaaccctgatcgaagttaccggtaccggcgcgctgaccattacccacgaaaacaccaagaaacgtaacaacggtatcgcggacggcaaagatgcgaacaccttcgcgatcgtgattaaagacccgctgggtcacccggttccgaacgcgaaagtgaactttgttctgccggcgaacctgcgtagcattgatcagaagaacaccggctactatagcctgctgaaccacttcatgtggaaggcgaaagcgaagaaagcggttagcgagcagaaatataacatcattgcgaacgacaagggtgaagcgagcatccaattcaccacctttattagcggtagctacgtggttaaagcgaacaccgagtatggcccggagatcaacgaaatgtaccacttcaagccggatattagccagagctttatcagcagcattgacatcattcgtaacaacgtggcggcggatggtatcagcaagaacaaaattaagctgcgtatcattaacaacagccgtcaaagcatcgcgggtgcgctggttcacttcgaagcgagcaacggcatcattagcccggcgaacctgaccgacgagtacggcaacaccgagctggaaatcagcagcctggtggaaggtagcattgacatcattgcgaccctgaacggcgatagccgtaccatccaggttaacttcctgaaatacgcgccgaccagctatattcaaccgagcaccgagagcctgtttaagccgagcatcaacgaacagaaccgtcacaccagcctgagcctgctgcgtgagctgtttcaaaaaatcggtcaccaccaccaccaccactaataagaattc

SEQ ID NO: 845 - DNA, 2093 bp, Artificial sequence; identical to SEQ ID NO: 844
  Optimized for E. Coli

SEQ ID NO: 846 - DNA, 2177 bp, Artificial sequence
  Optimized for E. Coli
ccatggagcgtccgagctatgcgggtgcggcgagcgacaaaccgagctacaccaccgagcaggcggcggaacaaattacccgtaccggctatcgttggaaagaacgtaacccggatggtaccaccccgatcagctatcgtttctttaccccgagccaagcgacctacaacaccccggcgggtgcgaacgagttcagcaagcaccagaaagaacaagcgcgtcgtgcgctgcaaagctgggcggatgtggcgaacattagctttaccgagaacgcgccggatgcgaacggtcacctgatcctgggtaacgatccgcagaccggcctggcgggttatgcgagctatccgggcgtttacaacaacggtacccaagcgtggttcgcgagcggtggcagcaactatttctttacccacggcagcgtgagccgttacgttctggcgcacgaaattggtcacaccctgggtctgatgcacccgggcaagtacaacaacggtggcagctatgcggagaacgcgcgttacgcggaagacacccgtgcgtacagcctgatgagctattggtgggcgggccacctgggtcacgatcacaacaaaaacggtcagacccactatgcgagcgcgccgctgatggacgatatcaccgcgattcaaaagctgtacggtgcgaactataaaacccgtaacaccgacaccgtgtacggcttcaacagcaacaccggtcgtgactttctgagcctggatagcccggacgatgcgccggtgttcaacgtttgggacggtggcggtaacgacaccctggatttcagccgttttcaccaggcgcaaaccattaacctgaaggcggagcactttagcgatgttggcggtctgaagggcaacgtgagcatcgcgaaaggtgttaccctggaaaacgcgattggcggtaccggtgcggaccgtctgatcggtaaccacgcggataaccgtctgaccggcggtctgggtcaggacattctgaccggcggtccgggcaaggataccttcgtgtataacaacgcgagcgagagcaccgaacaacgtccggaccgtattaccgattttaccagcggcgaggaccgtattgatgtgagcgcggcgctgcgtgcggcgggtctgaaagacctgcacttcgttcgtcgttttagcggccgtccgggtgaagcgctgctgggttacgatccgcgtagcggtcaccatagcctggcgattgacctgaacggtgcgggtcaggcggacctgttcatcaagagccaaggcccgattaaaccgggtgacgtgatcagccaagcgagccatgcgagcaccgcgccgacccgtccgtttcaagttaccccgcaaccgccgaccccggcgaagaccgcgccgtatgaaccgcgtcgtgagacgatggcgctgccgcagcaagcgccgttcagcctgcagaaccacgcgaacgcgaccctgaagggtaccccgatgcataccgcggcgcgtgcggtgggtagcattcgtgaggtgagcgttagccgtgatagctggggttacgaacgtgttcacacccgtagcctgggcaccggtagcctgatcaacgacggcaacagcgtgctgaccaaccagcacgttcgtgatgcgctggcgaagggtagcaaactggagctgtggctgggctatgaacaagacagcgcgggtcgtatgaaggtggagcgtaaagttccgctggcgccgaccccgctgagcggtgatgcgcgtctggattatgcggaactgccggtggatctgccggcgggcgagaagaaagcgctggcggaacagttcccgccgctgaaactggcgccgggtccgcaggcgagcctgggtcaaaaagttttcatgccgaaccacggccaggaagcgctgggtattagctttctgaacgcgaagggccaaccgaccaccctgaaaggctacgaccagggtagcccgtaccaaggtaccgtgtatcacgatgcgtttaagaaaccgggcaccagcggtagcccgctgattagcgtggacaccggcgaaatcgttgcgctgcacaacggtagcatcagcgcgaacgttaacggtcaccgtgcgagcatgggtaccgcgacccgtatcgatctgattcagcaacaccgtcgtaaacgtcaccaccaccaccaccactaataagaattc

SEQ ID NO: 847 - DNA, 2177 bp, Artificial sequence; identical to SEQ ID NO: 846
  Optimized for E. Coli

SEQ ID NO: 848 - DNA, 1649 bp, Artificial sequence
  Optimized for E. Coli
ccatgggtcaaggcgcggtgcgtggtcgtcgttgcacctgggatgttcgtggccgtccgtggctgaccaacagcggtcacgcgggtaccatcgtgattctggcgggcaaggatctggtgccggttgcgaaaaacagctacggcgttggtgcgagcacccaaaagagcaaacgtagcaccccgatgagcagcgagttccgtaacagccacctgcgtaacccggttgcgccgattgaagacccgggtcgtcgtcgtctgatgcagagcgcgctggcgggtagcgcgtgcctggtggcggcgccgctgctggcgcaccaaggtctggttgatagctggggcgagccgattggtcgtgaagcgaaagcgagcgcgggtgatgatgcgctgaccgttctgcgtgagagcctgctggcgggcctgaacctggtgccggtggttggtggcgttctgagctatctgggtgcgctgttcattccggcggtgggcaacagcgcggagcagctgtggcgtgaaatcgttgacgcgcgtattagcgaagcgctgctgcagctggtgaaagcggacctgttcggcctgaccggtattgttcaactgtacgcggacgcggtgcgtagcggtgatctggttgcgatcagcacccagagcattgcggcgaacacccaattcgtgggtgcggttccgcgttttgcgcaagtgggccaagaggttagcctgctgccgctgtatgtgattgcggcgagcctgcacctggcgctgctgcgtgacatggcgctgaaggcggttgatctgggttacaccccggcgtatcgtagcaccctggaagcgcaggcgaaagactgcatcgcgcgttacaccgcgcacgtggatcgttatgttgcggcggcgattcaagcggcgcgtgtgaacaacccgtacgactggcgtaagggcgattactatgagagcaacaaaccgctgacccagatgctgcaagtgaaggcggcgctgcagatcgcggttattgacatgcgtgatacctggtatgcgtttgacccggtgcgttttccggcgccggtggcggttcgtctgaaccgtgaggttctgagcccgatcattggcaagtgggaccgtaaaaacatcagcccggatgcgctgccgacctggcagccgccggcgagccgtattaaggaactgggtctgagcaccttcagcaccgcgggtggcgcgagctggctgcagggcatccacgtggtttaccaagacggcagcgagctggaaaccggtagccgtgcgacccaaggcaaacgtctgttcctgcgtaacaccagctttcacctgagccgtgtgcgtgcgcgttacctgcagggtattacccgtctggaagtggatcacaacaacggcaccttctggcaaggtggcggtccgaacagcggtgcgaacaccgcgagcatcagctataccggccaccgtgtgagcagcattcgtagcgttggccacggtcgtgcgccggcgctgaccagcgtgggcagcctgatcgttggttttcagctgctgaaccaagaagcggttccgattagcctgcagagctatgaccgtctggcgccgaacatggcgccgcaactgctgcgttggatcgcggatcaccaccaccaccaccactaataagaattc

SEQ ID NO: 849 - DNA, 2651 bp, Artificial sequence
  Optimized for E. Coli
ccatgggtaactacaacttcacccacaagatgaaaaccaagagcattcagaccctgagcgttttctttgtgctgatcagcttctttagctacagccagaaacaaaagcgtctgatcaccaactatattctgaccaaccagatccgtgactttaagaaaagcgacctgatcgatttcggcattgacaacgttgatcaaagcaaaagcctgaagggcgagatcgtgaaaattcagcaaaaattcaagcgtctgccggtttataacgcggtgggcaccgcgctgatcaaagatgaaaagattgcgtactttagcagcagcttcctgaagaactataacaccagcaccagcaacattgcgaccctgaacaaagagaaggcgctggaacgtattgcgatcgcgctgggtaaagaggacatcaagagcttccagatcattgagaacccggaaccggcgccggcgcaccgtaactttgttaaacaaaacctgaccttcgttgaggtggataacaacctgaaactggcgtaccagttttatctgcacgaaccgaagagccaaaacagctggaacattctggttgacgcgaacagcggcgagatcctgaacaaggaaaacctgaccgtgagctgcaacttccacccggacgcgtacggtcacgatcacagcaacgagaagttcagcgaaagcatcaacaagatcttcaccagcagcagcttcctggcgccggataacgcgagctataacatcttcccgctgccgattgaggcgccgttctttggtaaccgtagcgtggttaacaacccgtggattctgaccgcgagcccggaaggttggcacagcgacgttaccaaccactacaccaacacccgtggtaacaacgtgtacgcgtatgaagataccgcgaacaccaaccaaccgggttttagcccggatggtggcgcgagccgtaacttcaactttccgttcagcgttaacggtaccccgagctttaaccgtaacagcgcgatcaccaacctgttctacattaacaaccgtgtgcacgatatcttttatcaatttggcttcaccgagagcgcgcgtaactttcagcaaaacaacttcggcaaaggtggcgcgggtaacgattatgtgctggcggaaagccaggatggtggcggtctgaacaacgcgaactttaccaccccgagcgatggtagccgtccggttatgcaaatgtatctgtggagcaccgtgaaccgttacttcttttataacgcgccggcgagcgcgattccgcgtattccgcaagcgaacccggcgcagtttggtccgcaactgaacggcaccggtgttaccggcgagatcgcgctggcgagcaacatcaacggttgcagcgcgctgccggcgggtagcctggcgggcaagatcggtctgattgaacgtggcggtaccgcgaactgcaccttcgcggtgaaagttaaaaacgcgcagaacgcgggtgcgattgcggcgatcatttacaacaacgcggcggcggtgaactttccgagcagcatgggcggtaccgatccgaccattaccatcccgagcgttctgattaccaacgacgagggtgaatatgtgaaaacccaactgaacaacagcgtgatcgttaacgtgaccctgaagagcgacccggcgaccgcgctgaccccggacggcagcttcgataacggtatcattacccacgagtacggccacggtatcagcaaccgtctgaccggcaacggtagcacctgcctgctgaaaagccagagcaaggagcaaatgggcgaaggttggagcgatttctttgcgctgatgctgaccaaccgtctgggtgacaacgcgaacgttccgcgtagcattggcagctatgcgagcggtcagagcaccaacggtgcgggttttcgtccggcgaaatatagcccggacttcagcatcaacgattacacctatggcgacaccaacggtatggagatcgaggaagatagcgaaattgttccggacgtgcaccgtattggtttcgtttgggcgaccatgctgtgggatctgcactggcagtacgcggcgaagtacggctatagcagcgacgtgaccagcaacatgagcaacggtagcgcgcgtgttctgcagctggtgaccgatgcgctgaaactgcaaacctgcaacccgacctttatcgacggccgtaacgcgattctgagcgcggagatgctgaccaccaagggtgaagatcgttgcatgatctggaaaaccttcgcgaaacgtggcctgggtctgaacgcgctggcgggtaacaaaatgaacattagcgaccaggttgaggattttagcatcccgaaggactgcaccgatggtaacagcaacattgcgatcgatcgtagcctggtgaaaatttacccgaacccggcgaaggatgagttcttcatctacctgaaagactataccattggcaacgttcacgtgcaaatctatgacatgagcggcaagctggtgctgagcgagaaccgtagcagcccggatagccgtatccaggttagcacccgtgacttcgaaagcggtgtgtacgtggttaaactgcaaggcattggtatcgacattagcagcaagatcattatcaagaaacaccaccaccaccaccactaataagaattc

SEQ ID NO: 850 - DNA, 1976 bp, Artificial sequence
  Optimized for E. Coli
ccatgggtcagcgtttcaacagcgtggtttttaacaagctgccgcaagactatcagctgtacccgcgtgatggtcaaagcgagggcatcgttccgattagcggtgtggttgaagtgaccggctacagctatgtgagcgttcaggtgttccgtaacgacacctttgttaagtatctgaaagcgagcctgacctacgataacaagggtgtgggcagcttcgcgatggaaacccgtatcaaagcggaactggcgcaatatagcttcaaggtttttgcgtgcaaaaccatcgacagcaccctgattgtgacccgtaaaaacgtggttagcggtgacgtttttattgtggatggtcagagcaacagcaccggcttctttgacgaggcgagcaccgatccgtactgccgtaccttcggcaagatcaccgacattctgaacaccaccccgtataacccggcggataccctgtgggcgctgagcaaccagcaaaaatacctgaccggtgttggcacgatgggttttgagatccagaagcaactgagccaaaaatacggcatcccgaactgcctgattaacggtggcttccactggagcagcagcgtgaaccacgcgcagcgtaccgaaaacaacccggcggacctgaacaccggttatggccgtatgctgtaccgtgttcaaaaggcgggtctgcagaacgcggtgaaaagcttcatctatcgtcagggcgagagcgaagcgtaccacgagggtagcgattggccgggcaactttaagaaaattcgtaacaacctgaagctggacttcccgaaactggaacaaatctacgttttccagatcgatatcatctactttccgagcaccaccggtgcggagctgcgtgaatatcagcgtcgtctgccggagctgtatccggatgttcagagcctggcgaccgtgggtaccaagcaatttgatggcctgcactatggtccggagggctaccgtcagaacggcctggaagttagccgtctgatcgcgcgtgacttctatcaactgaaagataccgtgaacattaacagcccgagcctgaagatggcgttttacaccagccaggaacaaaaacagctgatcctggtgttcgacgagggtcagcaactggtttatccggaaccgtacaaggtgaacgaccaactgaccctgctgatgaaagatttcatctatctgaacggttttccggcgggtattaccaccgcgaacgcggacggcaaccgtatcattctggattttgcgaacagccagaacgcgagccgtttcgattatctgccgccgtacaccctggaaaccaactacttttatccgtacaacggtccgtacctgaccaacaagctgggcatgcgtgcgttcaccgttaacaactttagcatcgcgaacggtctgaacagcagcaacctgaccagcagcgtgaacccgttcgcgaacgcggttctgagctggaccgaagtgaacggtgcgaccggctataccctggagcgtaaactggcgggtgaaaacgactacaccattgcgggcaagttcagcgcgagcagccgtagctttgaggataaaaccagcagcttcccgggcaagatcagctaccgtctgaaagcgggcaacagcattagcgaaagcagcgcgtatgcgtacgcggaagtggaaatcccggtgattctgggtctggaggaaagcggcaaggacctgttcgaggtttttccgaacccggtggttaaccgtgaaaacgttaccatccacttcctgaccccggtgaagggtagcatcctgctgattaacagcctgggccaaattctgaaacgtcagaccgtgaaccgtcaaccggaggcggacctgtttctgcaggatctgccgagcggtacctacttcatccaactgcagaccgaagataaaagcctgaccaagaaactgccggtggttcgtcaccaccaccaccaccactaataagaattc

SEQ ID NO: 851 - DNA, 1976 bp, Artificial sequence; identical to SEQ ID NO: 850
  Optimized for E. Coli

SEQ ID NO: 852 - DNA, 2978 bp, Artificial sequence
  Optimized for E. Coli
ccatgggtatcgaacacccgttcagcctgctgcgtaacctggcgcgtaccggtaacgacacccacgagcacggcgatgaaaccctgagctttattaacgcgatggagaagctgaacatccacagcgtgttcgatattgttcgtcgtagcaaaagcgcgtttgtgcacgaactgagccgtatcagcgatgcgggtgcggcgctggcgtacgagaacgcgcgttgctatgcgacccaaattgttcgtctgtaccgtaaccagctgctgagcagcggtcgtacccagcaactgacccaacgtaccggcgtgcgtagcctggttgatatcggtccgggcttcccgaacctgtttaaggaaaactgggacctgttctgcaaagtgggtgcgattgaggcgaaagacagcccggttgcgtacctgaccagcctgtatcgttttgcgctggagcaactggaaggcagcgtggcggaaccgagccgtatcaagctggatgagcgtcgtccggacctgaaagatctgctgattgaccaccaaagcaccttcaccccggttccgaccctgcacatcgtgaaccaggttctgagcaaggcgattaacgcgtacgtgggtaccgttccggaagacaagggcaaaaccatctatcagctggttgcggagaaacagcacccgttccaatttccgtacaacttccactttcagcaaattagcctgggtctggatggcaagaaaccgaccctgggtgaactgagctatcgtgtgagcctggaagtgccgaccaccagccgttacggcagcgactatggcaaagtgcaacacagcagcgcgattgcgcaggttctgatgagcggtgcgggtccggaacagcaagcgattgttctggagccggcgctgagcagccaagcgaacgcggacaccagcgcggatctgacccgtcagttctttaagaccaaatacaacgtggactatgttgacgatgcgagcaacccgctgaacaacctgaacgcgttcctggaaaagaccggtctggacagcgatggtgtggaggcgctgctggcgatcggtaaccacaccgcgtacgcgagcccgaacattctgagcgcgggtcacaccaccgatgaggatagcccgcgtgaagcgagcctgaccgcgatcaaagcgcgttttggtgcgggctacgttaacggtccgaccacccagccggcgatggcgctgaacaaggatgcgtatggcattaaacgtctggtgaacaccagcgttgaccgtttcgatcgtctgcaacgtatgatccgtctgcagcgttggaccggtattccgtttaccgcgctggacaccctggtgatggcggtggttcgtagcgaaggcgcggttaacccgcaaatggtgctgaccgttaacaccctgcgtgcgctgggtacctaccgttatctgaacaagcgttatggcctggcgccggatgagttcgcggcgtttgtgcatcaaatgccgggcgaggcgaacgatggccgtctgccgatgttcgatcgtgtgtttaacaacccggcgctgttcgacaccccgctggttctggatggtagcaccctgtatctggaccagcacagcagccaacacgtgaaagcgcgtgcgcaactgagccgtgcgctgcacctgagcagcacccacgaaggtctgcgtcagctggcgatcgatgttcgtgagctgattggcaacgcgccgaccgactttcgtctgaacctgagcatgatcagcagcctgtaccgtcaggcgcgtattgcgagcatgtttggtctgaccaccgcggagtgccgtgcgctgatcgatctgctgggtagcctgagctttcgtaagaaagtggttagcggccaactggacgataccgaaccggacgtgctggatattctgatgcaactggactgggcggtgacctggctggaggcgagcgaccgtgatgttaccaccctgcgtcgtcaagcgggttgggatatgaccgaaaccatcgtgacccaggaactgaccgttcagctggagcaactgaccaacgacgcgcgtctggcggttctgaagggcgaccaactggcgagcctggatctgccgagcaaagacgatcagaacaacaccctgaactggtgggcgatcctgtactatcacctgattgatggtttcggcctggtgaccacccaaccgctggatgaggaaccggcggttagcatccgtcgtaccctgcacgaacgtctgagcagcattgcgattgcggagccgctggcgagcgaggtggaagcgcgtctggcgaccttcgttctgaacggttaccgtaaccagcaccgtctggtggaggaactgctgctgaccctgaccggtctgccgccggaccgttgcgaaccggtgatccgttgggcgggtagcgatgttagcaagtttctggcggcgctgctgtgggacaacggtgtgatcgaaaccctgagcatgctgattcgttatagcgaggttagccaacaactgggcctgagcgcgcgtgcgctgcgtaccttcctgattaacccgcgttggctgtacgcgggtagcgaaggccagttttatctgagcccgaacagcctgtacctgctggaccgttatagcaactggcgtgataactgcggttacccggaggaagcgctgctggagtatttcaagcaggcgaacgacccgcaacgtgatgcgacccagtgcgcggcgcgtctggcgagcctgaccggttggaccagcagcgaagttctggcggcgaacgcgctgctgaccggtagcgaccgtatcgcgagcagcatgcacgaggtggattggctgagccgtatgcacagcgcgagcgatgttaccggtctgagcgcgcgtcaactgctgagcgcgaccgatctgaccgcgaccagcaccgcgagccactggaaaagcgtgggtgaagcggttattgcggcgaaccgtcaccaccaccaccaccactaataagaattc

SEQ ID NO: 853 - DNA, 2813 bp, Artificial sequence
  Optimized for E. Coli
ccatgggtcagaccgacagcagcagcctgctggcgcaactgattgatcacacccgtccgccggcgccgggtcgtgatgatttcaagaccgcgctgcgtcgtctgaacatcaacagcgtgctggacattgttcgtctgagcgagggtgcgtttgcggaacagctgaagaaatacaacgacgatgacgcgcacaccgcgtatctgaaggcgcagagcgcggtggcgcaactggagcgtctgttcagcgaacagcaagttagcagcggtcgtccgagcctgcgtgataagcgtggctttagcgcggacaccagcgcgacctaccaggcgctgttcaaagagaactgggaacaattttgcgcgagcagcagcattgcggcggtggacagcccggttgcgtacctgcgtgcgctgtacctgttcgcgctgcagctggagcaaaacgcgaagggtgaaaacaccatcaaactgagcgatcgtcgtgcggacctgaaggcgctgctgattgaccagcacagcgtggcgggtcaagttccgatgctgagcatcattaaccagaccctgctgcacaacattgcgggtgcgaccgatgcgtacaccctgctgagcaaaacctggtatccgtttagcctgccgtaccactatcaccaccagcaatgccgcctgggtctgagcggcgacaagccgatgctgggcgagctgaactaccgtatcagccgtcagctgccgctgaaagatggcaccaacacctatggtcaagtgattggccaaaacaacgaggttcaatgcctgctgagcggtctgagcccggaacagcaaaccctgctgaaaagcgattgggttgcggcgcaggatgcgccgaccttctacagcaagtattttaactggaccgcggagaaaggcccggaaaacgttaccgatttcctgcaccacacccaactggacgcggaacagctgcaagcgctgctggcgcagcaaacccaggcggcgcgtaagagcccgaactacaaacaagacacccgttttacctacggtgcgtgctatatcaacggtgcgaacgcgccggcggcggcgattcgtcaggataagggtggcccggcgaaactggacaacgtgagcctggagcgtttcgatcgtctgcagcgtatgatccgtctgcaacgttggctgggtctgccgtttgcgcagctggataccctgctggttagcgcgatgcgttgcgaaggtgcgagcaaccgtgcgctgctgattacccacaacaccctgcgtgcgctgggcgtgttctgctacctgagcaaacgttataacctgcaggcggaggaatttgcggcgtggctgcatcagctgccggttcatgcgagcggtgaacgtgtgagcctgttcgaccaggtttttaaccgtaccggtagcgcgctgccgccgctgtacctggatggcaaggtgttcgacgcgaccaccgaacagcaactgtgcgcgggtctgggcctgcaggatacccaagacagcctgcacctgctgatcaccgataaaccggcgacccgtaccattgaaaccgtgagcgcgctgtatcgtcaggttcgtatcgcgcgtctgttcggtctgagcgtgatggaatgccagcaactggcgcagctgctgggcaagaccaacgttctgacccaactgcgtaccccgaccctgcgtcgtaaaccgcgtggtgcgaccgattttctggacgttctgatgaacctggagtgggcgagccgttggctgaaggaaaacggcaacagcctgccgctgttcaaacaccagctgctgctggatcgtcaggtgcaagacccggcgatcaacctgctggttaaggcgtttaacgcgtatgaccaggcgagcctggcgacccaactgaacctgctggagctgccgcagcaaccgaaagacgaggaaaaccgtctgccgatcgtggattggaacaccctgattccgcaggttctgcaaaacgcgcgtagcagcaccagcattgagcaggcgctggatgaagtgctgagcagcgttgcgatcagcaccgacagcaagcgtaacaccgtgattaaagatcaaaccaagccgaaactgctgaccctgctgaacaaggttcgtgacgagctgtgggcgctgtacctgcgtctgaaagatatcattcatgcggtgccgcacctgccgggtaacgcgaacggccaccagaagtacgaacaccaccgtcacttcctgcgtctgtatgcgccggcggcgccgccgctgcgtaccctgagctatctgatcctgctgctgccgcatgcggtggatgttctgcaactgccgctgagccgtcatgcgctggatcaatttatcattaacccgcactggctggatagcgactatcaagcgagcgcgctgctggagctgaccccgcacaccctgtatctgatgcagcaattcaaacactgcattgaccgtctgggtatgaccgaaggccaggtgctggactattttcgtcaagcgaacaccccgccggatagcgttgcgcagaacaacagcgaggaaaccaacgagcatctggcgcgtttctgcggttggagcgcgggcgaaatcaacgtgtttagccaccaactgaagccgccgcgtattaccagcatggaccgtctggagtggctgctgcgttgccgtcacgttagcaccgaaaccggtctgagcgcgacccagctgattgcggcgagccaactgaaaagcgacagcaccttcgcgcagtggcaagatgttggcgaagcgctgattagcgcgcacaccagcctgcaccaccaccaccaccactaataagaattc

SEQ ID NO: 854 - DNA, 2810 bp, Artificial sequence
  Optimized for E. Coli
ccatggttgaacgtagcaacgcgctgcaccaacataccccggcgctgcagctggttgacccgcgtggtctgccggtgggtagcattgcgctgtgccgtaccagcagcgatatcgagccgcagattctgaccagccacgcgagcttcgacatggcgggtcgtccggttagctgctgggatagccgtctgtgggcggatcgtgcgccggcgaacctgagcgtgattcacagcctgagcggtcaagtgctggcgagcgacagcgttgatgcgggttggcgtgtgagcctggcgggtgaagcgggtcaggcgctggttgtgtgggatgcgcgtggtgtggttcgtcgtatcggctatgatgcgctgctgcgtccgattgaagttttcgaagacgagcactgcgtggagcgtctgctgtatggtggcccggacagcaccgatcacaaccagtgcggtcaactgattcgtcatgatgatccggcgggtacccgtctggatgatgcgtacggtctgagcggcaacgttattcgtcaaacccgtcgttttctgcacagcgcggatgaaccggattggccggagagcctgaccggtcgtgatgcgctgctggaaccgggtgatggtgcgaccacctgctggcagtataacccgctgagcgagatcacctggcagcgtgatgcgcagggtaacgttcagtgcctgggttacaccgtggcgggccaactgaaggacagccgtctgcagctgaacggtcaggcggaacaagttctggtgagcgcgatccaatatgacgcgcagggccgtgtggttagcgaaaccgcgggtaacggcgtgattagcaccgcgctgtacgcggcggaagatggtcgtctgggcgagctgaacaccacccgtagcaacggtcagagcctgcaagacctgcgttatgactacgatccggttggcaacgtgatccgtgttgacgatcgtgcgctgccggcgatcagcaaaggtcaacgtattgacagcgttagcacctatcgttacgataccctgtaccagctgattgaagcgagcggccgtgagtgggcggtggttaaccacggtccggttctgccgggttttcagagcccggcggacccgagcaccctggcggattatacccagacctatcgttacgacgcgggtggcaacctgcagcaactgacccacaccggtacccagagccacagccgtaccctggttaccgcgcgtttcagcaaccgtagcctgccggtgatcaacggccacattccggacgaagcggagatcgcggcggcgtttgatgcgaacggtaacctgctggcgctgcaggcgggtcaaaacctgagctgggatcgtcgtaaccagctgcaacacgtgcgtccggttattcgtgaaaacggtatggacgatagcgagcgttatagctacgacgcgagcggccaacgtctgcgtaaggttcgtaccacccaggcgaaaaccatcacccacaccgcggatgtgcgttacctgccgggtctggaaattcgtaccgacaccgcgaccggtgaaaccctgcacgtggttgtggcgcaagcgggtcgtaacaacgttcgtgttctgcactgggcgagcggcaagccggacgcgctggaaaacgatcagacccgttacaccctgaacgaccacctgggtagcggcaccctggaactggatggtcaggcgcaacgtgttagccacgagcgttactatccgttcggtggcacctcttggtgggcgggtcgtaacgcgatcgaagcgagctataagaccgtgcgttacagcggcaaagagcgtgatgcgaccggtctgtactattacggcctgcgttattacgcgccgtggctgcagcgttggattaacccggacccggcgggtctggaggatggcctgaacctgtatggtatgctgcgtaacaacccgctgacctttatcgacgcggtgggtggcgttgcggaaattccgaaacacatccactacatttggctgggtgcggcggagccgctgatggaacacctggagggcatcaagaacaccagcgttctgaacccggattatcaactgaccctgcacctgcacctggacctgcgtaaaggtgatgaaaccgagattgcgagcgcgctgcgtggtcgtcgtaacgtgcacattagcgacctgcgtgaggaagagttctttcgtaagttccagaaaaccccgagctatgagatctacaaggatctgtatggtgacgatccgcgtcactacagcgcggcgagcgacgttctgcgttacagcctgatcaaccactatggtggcatttacagcgataccgacgatatgttcaaacgtggtgtgcgtgacaccgatttcatcaccaagccgaaacgtatttttaccatgcgtccgaccgacaccccgtggaaccgtgatgaaatcgttattaacaacaacagctttgcgagcccggcgaacaacccggtgctgagcaccctggaaaaagagatcgtggaccgttatagcgtttaccgtgaaaccggtctgggcaaggttctgagcagcaccgcggacgtgagcgatcgtatgcgtattgtgagcgcggttaccggtccgaaggtgttcaccgaagttctgctgaaagagggtcgtggcctgcgtaaactgtttagcacgatggtgaactatcacgttaagggcgaaaagctgaaaaacccgaaacgttaccaagcggaggcgcagaagcgtatgccgctgagcaactttatcaaaatgggtggcagccacagctggcagcaccaccaccaccaccactaataagaattc

SEQ ID NO: 855 - DNA, 1352 bp, Artificial sequence
  Optimized for E. Coli
ccatgggtcaacacctggaggcggcgccgaccgcgaccttcgacggcgattggtggtggggtgcgtttcgtgcgctgaccctgaaagcgctggcggcggtgccggaagtgggtggtatcctgagcttctttggtggcctgttcattccgacccacctgtttgacagcgaagatgcgcaatggcgtcagtacatcgacgcggtgaaccgtattgttgatcagaaactggacgatgcgatctatctgcaggtgcaagcgagcctggttggcttcacccgtaccacccgtctgtttctgagcgcgctgcaaaccggtgacgcgcagcacatccgtagcgtgattgatgcgatgaacgttagcttcaccgcgagcattcaaggctttatgctgaagggtcacgaagcgcgtctgctgccgctgttcgtgccggttgcgaacctgcacctgggcctgctgcgtcaggcggtgcagcaaggtcaccgtcgtggttttccggcggcggttatcctggactaccaggcgcaactgcagagcggcattgcggactatggtgcgtactatgatgcggtggttgagcagcaactgcaagcgaccgcgaaggcgcacccgcacgatggtggccgtcaccgtaacgaaccgctggcgagcgtgtacaccctgcgtagccaactgcagatcagcctgggtgacatgcgtgattgctgggcgtacttcgacaccgcgcgttatccggatgcgatccaagtgcgtctggaccgtgagctgtttagcatgctgattggcagctactatgacgatcgtgttccggaaccggcgaccgtgaccctgccggttccgccgaccggtccgatccgtagcattaccctgcaaggctacgtgttcgttgacggtctgaccctgagctatgcggcgggtcagggtccggaccgtgttgatgcggtgcatgttggtggcgcgggtggcgcgttctttagcatcgacgatattgtggagcgtggtcacgttcgtgcggtgctggttcaacacggctacgcggtggaccgtctgggtctggaatatggtgatggcaccctgagcggtaccgttggtaacaccggtaaccaagacccggcggcgcgtctggcgtttccgggtcaccacctgagcagcgtgatcggttttggtaccgcggcgggttatggtggcgttctgagcggctgcatgttcggttttcagctggatgaaccgagcgcgccggtggcgtttgaccgtcgtgttcaagatcgtctgcagcgtgtgtggccgagcggcctgcaagcggcgctgcgtcgtagcgcgcagggtcaccaccaccaccaccactaataagaattc

SEQ ID NO: 856 - DNA, 1352 bp, Artificial sequence; identical to SEQ ID NO: 855
  Optimized for E. Coli

SEQ ID NO: 857 - DNA, 1292 bp, Artificial sequence
  Optimized for E. Coli
ccatgggtcagaccgagaacgttctggacatccgtaccattgttgcgaacgagtacgcggtgaagaccagcgcgctggaatgggacgtgaccgatattgttaaaaacgcgatcattggtggcatcagcttcattccgagcgttggtccggcgatcagcttcctggtgggcctgttttggccgcagagcaaggagaacatctgggaaggtattgttaaacaaatcgagcgtatgattgaggaaagcgcgctgaagaccatcaaaggtattctggcgggcgacatcgcgtatattcaggaacgtatggcgaccgtggcggatctgctggagaaacatccgggtagcgcggaggcgcgtaacgcgttcaacaacctggcggagaacatcgatggctatcacaagaaattcaacaactttagcgacgatgttaactaccagattctgccgatgtttagcaccaccgttatgatgcaaatcacctactgggtggcgggtctggaacgtaaagaggagatcggcctgagcgacatcgatattgagaaagtgcgtggtctggttaagaaaaccgtggaacaagcgaacagctacatcaacaacatttatgaccgtgagctgaacgatgcgctgaacaacagcaccgcggacaccgtggttaacaacgtgatgagcgttcacggtcactgccgtctgcacggcattgaatatatcagcatttgggatcgtctgagcgaaaccgaaagcgtgaacaaccgtatctatgtggacgttctgagctacagcaccttctttgatcgtcagaccgcgaaggcgcgtattcaagcgctgaccccggagaaggacatgaccccgccgctgaaaccggcgctgaacggtggcaagcgtcgtaaaatcaacagcctgatgggtcacatcgttcgtattggtggcgcgccgcgtgtgggtggcctgaccgtggttttcgacgatggcagccgtcaccaactgggtaccatcagcggcgaaaccgcgagcattagcctggacagcagccgtatcaccagcctggaagtttggggtaacggcgcggttgacaaggcggtgttcaccctgagcgatggtcgtagcctgagctttggcgagccgggcaccagccgttaccgtaaattttatgtgggtgaaagccactacatcagcggcatttatctgagcagcgattacagcccgctggttggccaggcggcgaacattgcggtgagctaccaactgatcaacgacgatgaaaaacaccaccaccaccaccactaataagaattc

SEQ ID NO: 858 - DNA, 434 bp, Artificial sequence
  Optimized for E. Coli
ccatgggtagccgtatcaccattttcatcgacagcgatgagcagaagagcgaagtttacagcaacagcaccgtgccggttcgtaaagagctgaacaccgtgttcccgctgagcgaactgaccattagcccgggcagcagcgttgaggtgtttcgtatcgacaccccgatcattccggaaagccgtcgtagcctgcgtgtggttaacaccggtctggcgagccacgttaccgcgaagttttattggagccacagcttcaccagcgagtggtttgaaagcggcagcattgacgtgggtctgggcgaggataaagtgctgaacgttccgaacaacagcttctactatagcaagtttgtgatttacaacaacagcgataaagttgcgtatatcaccgcgaacctggtgcaccaccaccaccaccactaataagaattc

SEQ ID NO: 859 - DNA, 941 bp, Artificial sequence
  Optimized for E. Coli
ccatgggtagcctgcagtacctggacaagcgtctgatcggcgcgatcattgtggatgcgtggcagaaccacttcaacaccgagatggacccggcggatggtcaatggtttaccaacggtccgggcaacaacggtggcctgtatggcatcctgaccgacaccctggcgagcgaactgaagttcctgccggatcagcaagtttttaccatgaacaaaattgcggcggcgaccagcaccgcggacaaccgtaacggtctgaccccgcaccagaccgtgagcctgacctacgagtatcaaaacagcaccaccgttacccacagcaccaccaacaccatcaccgtgggtaccggcgttgagattaagagcagcgcggagttcctgggtaccggtgcggaagtgaccgttagctttaacaccgaatacagctatagctggaccgaggaacgtagcgagagcgtgagcgaaaccaagaccttcggtcaggaagttagcaccgatatcccgagcggcctggtgtaccaagttaccctgctggcggacaaagcgaacattcgtgtgccgttctatgcggatatcattctgaccggtcagagcgtggcgaactttgcgagcccggttaacggtcaaaaaacctgggcgattgatgcgggtaccctgtgcgagtggattaaccagtacggtagcgcgggcaacgaaagctaccgttatatgaaggatgcgagcaacccgaaacagggttttatccgtctggagggcaacctgaccgcgacccaaaccctgaacttcaccgcgctgaccagcgacattaccgatagctttaccgcgaccgcgcaaccggcgctgatgcgtgagctgaacaacagcgagctggaaaagctggaaagcaaagcgattaagaaagttgcgctgggccaccaccaccaccaccactaataagaattc

SEQ ID NO: 860 - DNA, 1397 bp, Artificial sequence
  Optimized for E. Coli
ccatgggtcagcagccgaaagtttggtctgaatacggtattgaaggctgtatttactacgaagacaaatacggttacctgagtctgaaaaccgacggcaacccgtctgaacacaactggtactttccgagcgacggtacaagtaacaaccgttgggactttattcagtggcgcgccggcatttttaccgacccgaaacagtggggtgacagtggcgcgaaaggtgacatttactacagcaaagaatacctgagctttttcattctgcagaaaaacggtaacccttcagagcacaactggtacttcccgtctgacggcacatcaaacaaccgctgggacttcattcagtggcgcgctggtatcttcactgaccctaaacagtggggcgactcaggtgcaaaaggcgacatttactactctaaagagtacctgagctttttcatcctgcagaaaaacggcaacccgagcgagcacaactggtactttcctacagacggtaacgacaacgcccagtggattgtgaaaggcaacatcaaaaaacaggaatggatcaaatacatcaacgacgaacgtccgattaaccagattagcctgccgggtacacacgacagtgccacctacacaattggctctgcagccattgttagcagttacgcgaaaacccaggacgactcaatttttgaacagctggaaagcggtattcgctttattgacgctcgttgtcgccacattagtgacgtgtttgcaatgcacaacggtaacatttacctgaacattaactttggcacaattctgaacgactgctaccgttttctggaacagcacccggacgaatttatcctgatgtcagttaagaaagaacacaccgaagaaaacaacacacgcagcttcgacaaaaccttcgaaatcaaatactacgactcttcacgttggtttgtggaagaccgcattccgaaactgaaagaagttcgtggtaaaattgtgctgctgcgtcgctttagcggtggcagtctgggcgttaacgcggctagctggccggacaaccagacctttaacacagaaaacaaaattcacgtgcaggacgaatacaaccagcacaacgaagctaaaaaatggcacgcgattaaaaacgcttgggactttggtgttgacaacagcaagaaaggttggctggtgctgaactttaccagcattgcagccgacacctttacatctattcgctcatacgcactggacaaaaacccggaaatggccaaatacattagtggcacaaaagcgaacggtggcgttgtgatctctgacttcccgaaaatcggtaaaatcgcggaaaacgttatcatcaccaactttggcgaagtggaaaaatttcaccaccaccaccaccactaataagaattc

SEQ ID NO: 861 - DNA, 1154 bp, Artificial sequence
  Optimized for E. Coli
ccatgggtgcagccgaaaaatggcagtacgacgttatcccggacaaaagcaaaaacatcatcaacgtgacagctaaaaacattacccagaacgcggctaacgacctgacatacaaagttaaagttgtgccgaacagcagtattgttggccgtaccgtgctgcgtcgcctgtttagtcgcaacgttgcagcctttgcaacagtggccggtattgaactgaccctgaaatctctgggctactcactggactacgacagccagacagtttaccgtgaaattaaaaccgacagtgacattggttggattgacctgaacggcatttggcacaacgacccgaacaaatggggtaaagcatgggtggacacatacaacagcaacggcgcgaccccgaaagctgtttttaaccgtgtggaactggacgagaaaaacacagcgtacctgtgggttgaccgcacctacggtgctgaaacatacaccagcaacgtgacatcttcagcttctcagccgaacccgaacccgcagccaaccccgaacgtgcgcgaaattctgaacccggaagcgattggtgacattgttctgggcaacccgccgaaaccggtgaacttttctccagaactgccactgccatcatacccgccggtttacagcccggaactgagtaacatttttaaaccggttccggacgtgaactacccaaacgacctggacccagcaccaaaccaagtgattgacctgctggacaaaagccagccgagcagttctgaccagattattaccacaaccccgacaccggacggttcaagcagtctgctgccgaacttttgtgactgggctaccccgatttgcagctttattgactggtttaaagacgacagtgcaattccggaaccggaaaaatacgaagttaaagaatttgacaaatctaaactgccgaccgcaccgcagttttcatttaacggccagtgtccggccccgaaaatttttaacctgaacctgggcctggcgtctacacagatttcactgccgtacgactacttttgttcttttgcgaccgacgttcgtccgtttgtgattctggcggcttggctgcacgcatgctttatttttgccggctttgtgcgctcacaccaccaccaccaccactaataagaattc

SEQ ID NO: 862 - DNA, 1154 bp, Artificial sequence; identical to SEQ ID NO: 861
  Optimized for E. Coli

SEQ ID NO: 863 - DNA, 3311 bp, Artificial sequence
  Optimized for E. Coli
ccatggcggacatgtgggtgctggaccgctacgacaacccgctggctattctgagcagtgacgctgaagacgacgcatgtacatttcactctgaccagtttctggaaaaactgaaccagggtaccgaattttcatttagctgcgacgcacgtcacgaagactcactgcacgttaacaaactgaaccaggttgtgtttcgtgacgaagacggtttctttcgcctgtttaaaattcgtgaaattgaccgcggtaacggcgacaacggtgccgaaaaaattgcgcactgtgaaccggctgaaatggaactgctggaagcaattgttgaagacgtgcgtccgaccggcaaaacacagcagtacgcactggaccgtgtgctggaaggtacccgctggaaaggcaacgttacagcccagaccggtacacagtcaacaaacttttaccacattagcgcttacgaagcaatcaccaaaatcatcgaagtgtggggtggcgaactgcgttttaccgttaacttcgacgaagaaaacaacaaaatcattgaacgcgttgtgaacattgaacagcgtcgcggtaacgacgaaggcgaccgttttgaagttggctacaacgtggaaagcattaccgtgacagaaatggcttacccggttagtgcactgtacggttggggtggctctgtggaaaccgaaaacggtggcgactctcgctacattgactttgcggacgttgaatggaaagtgtcaaacggcgacccggctgacaaaccgaagggtcagaaatggattgaactgccgggtgcaaaagaaaaatacggctacaaaaaatctgacggtgcctttattaactcttttggccagtggcaggacgaaaacattaccgacccgaaagaactgctgcagaaaacctacgaacacctgcgtgacacagccagcaaaccgcaggcgacctacgaactgaaagtgattccgaccgaccacattagtctgggcgacacccgcacagctattgacgacacacaggcagacccgattcagattcagagccgtgtgattgcactgggttacagtatttctaacccggccggcaccaaaacagttgaaatgggtgaatttctggaaatttaccagccagaccgtcgcctggacgacctggaagacaaagttaaaaacattgaccgcaacgttcaggtgacagacggtagttttccggacattattccgaaagttccgtctaacgtgaccattaaaggtctgtttagtggcacctctattacatgggactacgacccgtcttcatacattgcagcctacgaagtgtacggttcacagaccacaggctttaccccgagcattgaaaaccgtctgtggcgcggtaaacagagtggctttctgcacgaaaacgcgggcgttgacaacgtgtggtactaccgtattcgcgccgttaactaccacggtaaagcgtcagaatttaccgctgaatttagcgcaaaaacccagcgtattatgacagacgacattctgtttggtgccgtgacagcggacaaactggctaacctggcagttaccgcggacgctattagccgtaactttgaagaagcaaacattctgccaggctcactgctgcgtctgtctgacattctgcgtgtggacagtcgcgttattgtgaacgaagtgaacggttttaacgaactgtcagttacaaaagacaccacagaatacaccagctttggctttaccacaggtggccgcaacagtctgaaactgaccaaaggtgaaacctacacactgagctttgaactgaaacgtgaaacactgaacgactttagttacattcaggtgcgctcaaaaagcggcacccagtacaacctgaccaacaactttacagacctgagcagttacccgacagacgaatttgtgcgttttgacctgccgtttgtttctccggccaccctgacagacggtcgtgtttgtctgggtggccgcacccagaacctgacagactcagcgaactttaccattcgtaaagtgcagattcgtcgcggcaacgttcgcatgtcatttggttttagcccgtacgacacccagctgacagacggcgcagtgacatctgccattattgcggacgcggctattacctcagctaaagttgcagaagcagccattggtaccgcggctattcagaacgcagccattgcacgcgcccacctgcaggaagccattattgacacagttcacattgctgacgcggctattacctctgcaaaaattaaagaactgagtgccgacctgattacctctggcacaatcaaagcaatcaacatcacaggttcactgattcgtggtggcaaatttcaggccctgaacaccaacagtaactttgactcttactttgacggtgacaaactgtaccagtacaaaatgaacagtaaatctcagtacaccaaactggacatttcttcaagcctgatttaccaggaagcgggcgctgactactcaattgacggtagcaaaccggaaatttggcgctcagtgagcattggtaacggcaaagttagtgtgaaaggttctggcgaatttaccaacgccagcaacatggcggttgtggaaatgtacggcgactttaacggtgacggcgacggtattggcaaatttgtgattcgtaacgaaacaaacaccacagttccgagtgacatttttaccctggaaggtggctacgacccgattgacgttaacgaccgttacaacgccaactacacaaaccgcgcgaccattacaggtagttctaccctgctgagcctgcagccgctgaactttgaaacagttgtgaacggtggcattcgtatgaaatcaagcaaacgcaccgtgtttgaaggcgccccggttgaactgccgaaaaaatctacaattatgccgggtgacgaccagtttaccacacaggaaaaaattgttggtggcaacgtgaccagtctggttacagacattcacggcgcgctgcagaacaacctgatgatttgcattacccagattgacgttacactgggtgcttctggtggcgcatacgcctacgcgtacaactggtacaacatggtggacggtaactaccagggcgcggaaaacatttttgccgttatggcgacaccgtacggcaaaaacgctaacaacgttaccgtgggtattatgtcacagagttctgaaaaatttgcggttcacgttcgtggtacaggtgctacagacgtggcagccaccacagttaccattcgtctggcaatcttttacgagaaaaaacaccaccaccaccaccactaataagaattc

SEQ ID NO: 864 - DNA, 2903 bp, Artificial sequence
  Optimized for E. Coli
ccatgggctcagaaaccagcgaaagtgctccggaatcacagaacgacccgagcctgggtctggaacgcaacgcaacaattacctttgaaacctctccgtcagaaggtggccgtccgagctttgctccgcacattaacccgccgtggggtagtctgctgtacacaatttctgcaaacccgaaccagggctttcgttttgttcgctgggaactgattaacggtctgaacgctagcattagtaacctgaacgaagaaaccacaattctgtctatttcaaccggtggcccaattggtccgccggttcacgaaacaattaccattcgcgcaatttacgaacgtgtgtacaacctgacctttcagtcttctccgattgcgggtggcaacccacgtgctgaccagacaattctggcacagggtgaaaccacaaccattcacgccaacgttagtaacggctaccgctttgttcagtgggaactggtgtctggtaacacaaccattgcgaaccgtaccagccagagtacctctattacaatgggtgccggcgactcttcaattcgtgcggtgtacgaacagattacacactcagttagcgtgcaggccaacccgaccattggtggcaacccgacagcttctgcaagcagtgcagcacagggtgctaccattaacctgaacgcaaacccggccgttggttaccgctttgtgaactggcagtttctgacacagaacggcgctacaattaccaacagtaacctggcaaacaccaacctgcgtatgggtacaggctctgttattgtgcaggccaactttgaacgcctgcagcagggcagtgttattgtgcgttacgttgacgaagtgggtaacgaactggcgcagtctgacatgctgaccggttttagtggcgaatcttaccgcacagaagcgaaagctattgaaggctgggaactgctggcgattccggttaacgctaccggtttctttacaaacgttgaacagattgtgacatacacctaccgtaaaaaccagcagctgtggggcacagtgccgtgggaatacgacgaagctacaaaaaccattcacctgtacggtggcattgccggttctgttccggaagcgccgtggaaatcaacctttgaagtggaaaccattattgttacaaacgaagtgtttctgccggaaaacagtgcttctctgtttaacggtgcacgccagctggaatctattgaaggtgttggcaactttaacacctcaaaagtgacaaacatggacgaaatgtttgcacgtaccagtgccctgaaagaactggacattagtcagtgggacgtttctaacgtgacctcaatgagccacacatttgcatggatgtctaacctgcgtaaactggacgtttcacagtgggacgttagcaacgtgacaaccctgagccacgcatttgcctggaccagtaacctgattgacattgacgtgtcacagtggaacgttggtaaagtgattgacatgggcaacctgtttatgtcttcaagcagtctggctgaactggacctgtcaaactgggacacccgcgacaaagacattcgtggcatgtttcacctggcaagccgcctgtcttcactgaaactgggtgaagaatcagttattggcaacaccagcctgcgcacaattgtgccgaccgccgaatacacaggtcgttgggttctggaagaaagcctggacagcagtgtgcgtaccattgcttttgaaaacagcaacgaatttatggcaaactacgacggtagtcacccgggcacatacgtttgggaacgttctcgcccggaagaactggtggcggctctggaaccgctgtcagaccagagcattgctattaccggttggatgaccgaagttacagacaaccgcacaattacctaccagaacacagcaggccagacagttaccgtgacaaaagaaagtccgcgtattaaatggggtgactaccaggacgcggaccagcgtattcgccagtttgaaattccgctgaccgaaaacgaacgcctggccaccgacacagaagttaccctgacagtggcgaaaccgtctgttgaaacaaccggcgacctgacaatcgaaaagaaagttatcaaaggtctggactacaccgccaaccactttacactggaacgcaaaaaactggaagcactgacctcagaagccgaactgcacgaactgattctgaaagaaagccaggcgaccgctcacgacgtgctgacacaggacgaccgtagtcaggaaattaaaattgttgcgaccgacctgacaaaagacgacgtggacgacggtacctactttgccacatttcaggttggcaacaaagcgtaccagtttaccattggtattgacgtgaacagcaaaattcaccacctgaaagttagtattccgaccaaaatggtgtttgaatcactgtaccagggcgaagaaacaaaccgcgaatttgttagcccggactacgaaattcgtaaccacagtgacctgtctgttgacacctacgtgaaccagtttattattgaagacgacgccggcgtgattctgctgcgtgaagacgaaaacccactggaccacgcgccgctgcaggaaggtcaaccgaaaaacttttctgacattaaacagccgctgctggaactgcagctgatgagtaacgaaacaaaaatttctctgtacggtcgtcgctcagaacagcgcctggcgcaggttgctccgtactcttcagtgccgtttcacctgaccggtcgtttttacggcccggacccgaagtggattgccgaatcagacaacgaacagggtggctactaccaggacagctttgttccgacctaccgtatgattctgcgctttgtgccgcgtcaccaccaccaccaccactaataagaattc

SEQ ID NO: 865 - DNA, 2903 bp, Artificial sequence; identical to SEQ ID NO: 864
  Optimized for E. Coli

SEQ ID NO: 866 - DNA, 2951 bp, Artificial sequence
  Optimized for E. Coli
ccatgggtattgaaaacagtatggaactgccgagcaccagtgaactgccggacccgctggcctcaaaaatggaaacaaaagcgccgatttttagctttgaagaaaaccaggaaccgcagatggcaaacaaacagtttcagctggttgtgcgtagcagtcaggacgtgtctgaatttgttctgaacctgccggaaggtgttagtattctggaagacaaacagtctaccgacatcaaattcaaaaacatcgaaggcaaccagtggcaggtgcagacagactcaccgcagatgacctttagcattccgctggttggtgaaaaagcgggcgcttacgaaattgcggtgggcgaatcaaaaaccatgctgaacattcagccggaagaaagcccgcagaccacagaacaggaaatcatctcttcagaagaaaacgaaacagaaaaaaccggtgaaagtaccgttgaagaagaagcaaacggcgaccgtgaagaaccgagcagtaccacagacacatctcagaacgacccggaacaggtgacagaaaacgcccgtctgaccaaagaagcgcgcgttcaggacgtgaccaactgggaagaatttattcaggccttttctgaccagacaatttcaaccattgaaattagcaacgactttgaagttccgaccacaccgctggcgaaccagacaggtctgctgaccggcaacaactcaaacgtgtctggttcagctaccttcgtttacctgatcaaatcttcaattagccgcaccctgacaattaacggtaacggccaccagattgactttggtagcgttagtctgggcatgtacccggcgacccacaacgaaaactcaccgtggaacattacatttaacgacctggacgtgtacagcggtaactggtggggtttctttcagaccacaaacctgaccgtggcacagcactctgtttcaaacattacactgaacaacattacctcatacggtaacgaactgattgccccgtactacacaaacgttgacattagtggcgttgtgaacaaccacattaccgaaacatacacctctaaatttcgtacaaactggcgcgttaacaccgtgaactcagttaacctggaaacacgcagcctgaccattaaagaaaacgcagaactgaacctgagcagtgtgaacagcggtaacctgattattggcctgggtggcctggacgctaacctgaccctggagaaaaacgcacgtattaacattgaaagcaacggtgcatctgctggtgacaacgcaaacggtcgtggttcttcaattgacattgttaacggtaacctgattatgaacgaaggcagtaccattaacgtgatgaccacacgtaacttttctgctctgaacctgcgcagtgcaaactctctggttaaaatcgacgacggttcaaaaatcaacatcaacagcatcagtcacacctgggctagcaacgcagcccaccgtaacctggtgtacatggcaacaggtagcagtctgagtgtgggcgaagaatctgaatttaacgttgaagcaacaggtcgcggcaccgcggcttctaacattgttcacattgcgggtaacgctaactttgcagtggacaaagacggcaccctggacattaaatctgactcaacaagcaccagtcagtctctgctgtcatttgcgagcgctggtagtacatttcagtttagtgacgccaaacgtgttaacctggaacgcacaggtaccattgcgggcacctctaccacaaacggcctgattaacattgctggtagtacaggcctgctggacattgacgtgcagtctgttaaacagtgggcacgtggtaactttgaagaaacaccggaccactcatggaccccgatttttaacctgaacctgcgttacacaggcgttgtgccgcgcattgaaaccgtttcttcaattgctcaggaaacagcagacagctttaaacagtactttaccacacagaacgtgcagcgcattctgtttgaaaaaattccggacgttgaagtgacaattgacccgctgaccgaagacccgaacgaagttaacagtcacacaattaccggtaaagccaacccgaactcagtgattcgtttttctggtgacccggcaattccagctggttctattacctcaccggacatttcagaaagcgaaaaataccacaccacagcagacgaaaacggcgactaccgctacgaactgccggaagaccgtcgctttaccgccggtaacacagtgaccgcatacgcctttctgaacggcaaaaacgacacagccagcacaatggttgaagaaaaaattgtggttgctccagttgacccactggacccagaaaccgaagtggaaccggaaaacaaaccggaaattccggaagaccagggtcgtctgagtctggactttgtttctcagtttaactttgaaacccagaaaattagtgtgtctgaccagacatactacgcgcagccgcagcgtctgctgaacgaagacggcacagttaacgaaaccgaagaacgcccgaactacgtgcagattagtgaccgtcgcgcagccaacgaacgtaacggttggcagctgtctgttacccagaacggccagtttcgcaacaaaagtggtaacgaactgattggctctgaaattcagctgtttaaccaggaactggtgacagctcagggtggcaccaaaccggaactgcaggaagaaccggttcagcagattctgccgaacacccgtaaagtgctgattaaagcgaacggtgaatcaggtacaggcacctggatttaccgctttggtgaccagcagacagctaacaaaagcgtgggcctgtacgttccgggtggcacaaacccggaagcaacctcatacagcacaaaactgacctgggaactgagcgccgttccggaaaaccaccaccaccaccaccactaataagaattc

SEQ ID NO: 867 - DNA, 2951 bp, Artificial sequence; identical to SEQ ID NO: 866
  Optimized for E. Coli

SEQ ID NO: 868 - DNA, 584 bp, Artificial sequence
  Optimized for E. Coli
ccatggcagtttactttgtgaccggtaaactgggttctggcaaaacactgtcagcagtttacaaaattcgtgactacctgatgaaaggccgcaaagtggccaccaacctgaacattagctttacaggcatgtttggctaccgtgcgaaaaacattaacctggttcgcgtgccggacaaaccgaccgcgtttgacctggacgctattggtcgtggcaacacatcttacaacgaagacctgaacggtctgctggttctggacgaatgtggcacctggtttaacagccgtagttgggccgacaaatcacgccaggacctgattaactggattgcacacgcccgcaaactgggttgggacgttctgtttctggtgcagagcctgcaggttgtggacaaacagagtcgtctgatgtttgctgaacacgttgtgtactgccgtcgcatggaccgcctgaaaattccgtacattcactggattctgcagattattacactgggccagtttcgtctgccgaaaattcacctggcaattgtgaaatacggcgacagcccgccgcaccaccaccaccaccactaataagaattc

SEQ ID NO: 869 - DNA, 2804 bp, Artificial sequence
  Optimized for E. Coli
ccatgggtcagacagacaactctccgctgctggcgcagctgattgaccactcacgtccgccggctccaggtcgtgacgactttaaaaccgctctgcgtcgcctgaacattcactctattctggacattgttcgcctgtcagaagaagcttttaccgaacagctgaaaaaatacaacgacgacgacgcacacacagtttacctgaaagcccagaacgcagccacacagctggaaaccctgtttcgtgaacagcaggtgagcccgccggcaagcagtccgcgtaacaaacgctctattccgccgaaaacctcagctatttaccaggcactgtttcaggaaaaatgggaccagttttgttcttcaagcagtattgcggctgtggacagtccgattgcctacctgcgcgcgctgtacctgtttgcgctgcagctggaagaaaacacaaaagacacccgtgctctgaaactgtctcagcgtcgcccggaactgaaagacctggttctgaaccagcacagcgtgagtggtcaggccccgatgctgtcaattgttaaccagattctgctgaaaaacattgctcaggcaaaagaagaagacacctacaaagtgctgagcgaaacatggtacccgtttagtctgccgtaccactttcaccaccagcagtgtcagcagggtctgtctggcgacaaaccggcactgggtgaactgaactaccgtatttcacgccagctgccgctggccgaagaaacatcttcatacggtcaggttggcgaacagaacaacgaagtgcagtgtcagctgtctggcctgagtccgcagcagcagaccctgctgaaaagcagttgggttacagaaaccggtgccaaagcgttttaccacaactactacaactggaaaagcgacctgattggcccggcaaaactgaccgactttctgagtcacacacagctggacgctgaccagctgcaggctctgctggcactgcagacccagtctccgcgtcagtcaccgaactgtaaacagaaaacatctctgtcatacggtgcctgctacattaacggcaccacaaccccggcgattagcctggacaacgctaaactgaccaacattagtctggaacgttttgaccgcctgcagcgtatgattcgcctgcagcgttggctgggcctgccgtttgcacagctggacacactgattgtgagcgccatgcgttgtgaaggtaaccgcaacaacaccctgctgattacacacaacaccctgcgcgcgctgggtgtgttttgttacctgagtaaacgttacacactgcaggcggaagaatttgctgcatggctgcaccagctgccagtgcacgcttctggtgaccgcgttagtctgtttgaccaggtgtttaaccgtacaggttctgctctgccgccgctgtacctggacagtgctcgttttgacgacacaacacgtcagcagctgtgtgctggtctgggcctgcaggacacacaggacagcctgcagctgctgattaacccgaacaaaccggctacacgcaccattgaaaccgttagcgaaatttaccgccaggcccgtattgcgcgcctgtttggtgttagtgttgtggaatgccgtcagctggtgcagatgctgggcaacgcaaacctgctgatgcagctgcgtaacccgaccctgcgcaacaaaccgaagggtatgacagactttctggacgtgctgatgcagctggaatgggcatctcgctggtttaaagaaaacggctcttcactggccctgctgcgctgtcagctgctgctggaccgtcaggttcaggacccggtgattaaccagctgctgaaagaatttgccctgtacgaccaggcgagcctgagtaaagctctgcagccactggacctgccgcagcagccaattgacgaaaaagaccgcctgccggcagttgactgggaagctctggcatacaccgccctgcagcagatgcgtccgtctaacaacattgaaacagcactggaccacgttctgagcagtgtgcagatttcaaccgccccggcgcgtacaacccagctgattaaccaggccaaatctaaactgcacacactgctgtcaaccgttcgcgacgaactgtggagcctgtacctgcgtctgaaagctattattcaggcagtgccacaggcaccaagtgacgctaacggttaccagaaatacgacaacgaccagcactttctgcgcctgtacgctccagctgctgcaccgctgcagaccctgtcttacctgattctgctgctgccacacgctgctgacattctgcagctgccgctgtcttcacaggcgctgcaccagtttctggttaacccgcactggctggctcgtaaatacaaaatgccgtcactgctggaactgacaccgtacaacctgtacctgatgcagcagtttaaacactgtattcaccactgcggtctgaccgaagaacagctgctgaactactttgaacacgctaacgcactgccgaacagcacagcccagaacaccagtgaagacacaaacgaacacctggcgcagctgctgggctggtctgcttcagaaattgacgtttttagcaaccagctgaaaccgccgcgtattacatcaatgaaccgtctggactgggtgctgcgttgccgtcgcgcaagcattgacaccggtctgccggccaacatgctgattaaagcatctgaactgaaagccgactcagcctttgcggactggaaaagcgtgggcgaagctattaccagtgcatacccgcaccaccaccaccaccactaataagaattc

SEQ ID NO: 870 - DNA, 2441 bp, Artificial sequence
  Optimized for E. Coli
ccatgggtcgtaacgcatctgaacgcaccgacattctgagcgaaagtgaactgctggcctggctgcgtgttaaaccgcgcacactggaatgggacgcactgctggtgtacgaccgtacccgcgccaaccgtctgctgctgcaggaatacattcgtcgcctgcactctgaatcatttctgccgccgattacccgcctgattaaccacgttccgggtgcacactgggaatacattgctgaccagctgctggcagccccgcgtctgtcttttgaagactcaacaattaccagcagtatggcgaacctgacaatgcacgtgatgggtggcacccagtggagcattcagaaacagccgaacggcccgcgtcgcattgttaaaattgaagtgattgacacactgcagggcccgaaactgaccggtcacgtttttctgagcgaagttgaaggcagtgtgaccgaagacggtaaagttcagattaacctgcacgaagcggtggacctgcagtttacatacgctgacaccacaattatgcgtgaacaggccggtgactactttcagcgcctgtttgaacacctgccggaagaacagcaggtgtttgttctgaacgaactgggcccggttgacgaaaacgactttctggacccgcacacctttatgtttcgtatttttcgcgccaaagacgcgcagtaccgtgacagtccgacatggggcgaaggtgctattctggcatttattaacggcaaaggtaaccagagcaaccagggcccgattagtgacgtgggttgggtttacccgattccggaaggccagtctgttaccctgctggtgtcaaaccgttttctgattcgcaacctgctggaaagcggcattcgcgacatggcggacggtaacgttattattgaagtggaaaacccggacaacccgagtgctccggcaggtacaatgcgtgcaggtggttttcgcaaacaggacctgctgcagagcgttccggacgactacggcgaagacccgtttttcgacagtgtgcgttacacagcgacctttccactgaacagccagggcagtccgccgggtgaatttgttgtgcgtcacgaaaacgaacgcattattatggaatggagcggtagtacagtgaactctaccccgcagcgtatgccaaccctggacctgcagtggcagggcaaatcatgtcgtattacactgctggctgaatggcactttaaacgcgcttacgtttttaccgcaggccagtacggtgcacgtctggaagtggaccgtgctcagtctattgacgaagctaaagttacaccgctgaccgtgtcaccggaatacggtaacgaagttatggaccactggctgccgctggcacagtttaccacaatttctctgctgctgaactcatttgacaaagtggccctgccgacccgtgaaattgacctgtttcgcctgcactctctgctgtttcagtctgaacactcactggttctggaatcaggccactacccgaccgacctggcgatgtttggtcagctgagcccgcaggaaacatactttgctgttgaaccgcaagaaagtctgatggccccgggtgcgaaacagcagatgaccggcgtggacggtgcggtgtggaaagttaaaggcgtgccgggttttgacgacggcgctggttctattacaccgacaggcctgtacacagctccagctgcttcagaaattgctggtcaccacaccattgttgtggttacagcgacccacggccgtcagacatcttcagctctggtgcgtgttctgaaacgcagcgtggtttgtaacccgcaggtggttgtggttggtatgggtggccagcaggttaaatttagcgcaggcagtctggctgaaggtgcactgacatgggcactgaaatctgactcaggcgccaccctgaaagaaattccgctggacaacgacgtgccgtttgaaccgggcgaccacttttacaccagtggtccagcgccgcagcgtcacgctgacctgctgccggacaactttattggtattgacgaagtgattgttacccacgacgccagcaaagcgaccacaaccagttacgttctgacactgctgctggacggcatggcagaagtgcgtgttattccgggtagcatgacagccacccaggtgaaactggaaatgcgcaccagtgacccggaaccgattccggaaccggactgggacgtggttctgggtggcggttctgttgacgcagacggccagtacacggctgacctggcagcagctctgccatttgcagtggttcgtggttttaaagactacggctttccgggtgtgccgcagttttgcggctacattctgctgtcagttccgctggttgacctggaagccctgaaagaacacgactgggacacagacacccaccaccaccaccaccactaataagaattc

SEQ ID NO: 871 - DNA, 1766 bp, Artificial sequence
  Optimized for E. Coli
ccatggcgaccgctaacgacattaaactgacaggcaacccggaaattgaccagtttttcagcggtggtattcgtctgctgccgaccgagggtaacacatactactggcacatgccgaacgaagttcacagcagtgttaccacagtggaaccgattaccaacgaactggcaaaaaacatggttcgcgaagccctgcagcagattagcaacgtgatcaacatcaacttccaggaagttaactactctgtgtcaaacaccggtggctttgacattctgagtggtacagacctgtacccgatggaaggtggcattagcctgaacagtgaacagtctgacgcaaccattcagtttctgaacaactacagcgacaccaacacaagtatttcttcaaaagcccgtaccattacaatgcacgaagtgctgcacctgctgggctttgacgacggtccgatttctcgcaacccggactacaccacagttgactcagtgatgagctacaacagtctgattgacgaccgttacggcgaaaaagttcgctcatacgtgtacgacgaaaacggctctcagatggacggtacctcatgggcaaccacagacacactgggtatttacgacattcaggccattcagagcatttacggcgcgaactacaactacaacgctggtaacaccgtttacaaatacaccccggaaacactgaaaaactttcagaccatttgggacggtggcggtattgacacaattgacgcgagtgaatttattctgggcgtggaactgaacctgaacgacggtacccgttctaacctgtttattaaagactactcatggaacggctacgaatacgacggtacacgcgcgattggcattgcatacggtgccaacattgaaaacgctattggcggtcagggcaacgacgttatttacggtaacgaactgaacaacgtgattagtggcaacgacggtaacgacattctgtacggtgctgacggtgacgacaccctggacggcggtagcggtaccaacacactgtacggcggtagtggcaacgaccgtctgatttctaaaggttcagacaccctgtacggcggtgacggcaacgaccgttacgaaatttctggtacagactttcgcattattgaagaacagaacggcggttttgacaccattgacatttactcatttgacgcagccacatacgttatgccggaacacgtggaaaacattcgcctgaacaccggctgggacattaactctaacctgaccggtaacgacctggacaactcaattcacggcaactttggtaacaacattctgattggcggtaagggtaacgactctctggttggctaccgtggtagcgacacctacatttttagtaaaggcgacggtcgcgacacaattgacgaatacaacaacaacaacgtgccggcgaccgacacagacattctgctgtttaacgacattagcattgaccagctgtggtttagtaaatacagcagttggggcgacgaatcactgctgattaacgttctgggcaccacagaccaggttaccgtgtacggttggtacacaaacaacgctaaactggaacagattaaaacccaggacggtgttacactgtctattgaccagattgaatcactggtggacattatggcgaaccagaccatgccgctggctaacaacagcacaattattgacgactacctgatggtgcagaccagtatgattatgggtcaccaccaccaccaccactaataagaattc

SEQ ID NO: 872 - DNA, 1505 bp, Artificial sequence
  Optimized for E. Coli
ccatggacaccaaaaacgacaacacagttcagggcattccggtgaaacgcaaaatgaaaattccactggactctgctgtgccaagtggttacccgattccgaaactgaaagctcagctgaccgacctgggtctgacctgtgaagaaacaagcgaagaacagctgcagcagtacaaagacgacgttatgaaagactttaaaaccggttctcgcacaatttacggtctgtaccgtggcaaaccgaaagcaaacttttacacatcagacctgctgggtgccgacggccgttttcgcgtgaacggtaacgaatttatgaacgcgctgggctacaccaaactggctgaaaacggtagctggacactggacgacgacgcggaaggctaccgtgctgaactgtgcaccatcatctacgaagacaacttcgaatttctgaaaacagactacccgtttgactttaacggccagaaaaacagccagagtcagaccattaacgaaccgaccggtaaagcgattgaaagtacctttagcagtatggcgaaagctgttgtgggtgttgtgcagagcggcatttcttcagacgacctggaaaccctggttagtacaattattgacaaaaaccagagcagtaacattcacgactacgaaatgaacgacgttctgattgcatacctggtgaacgactacgacccggttaaacaggaagcagttgccgtgggtgccctgtctatctcatactacatccacatcaaagactacaaagacaaaggtgacaacaaagacggccgctacaacgacgcaattattcaggttaccgcccgttttgtgagctacagtgacctggaatacatggaacgtgacctgaaacgcattgaaacccgtacaaaagctctgtttgaagtgcaggaacagtctcgctacctggttaaaggcaactgttttaccctgctggactcttcaggtggcattccgccgaaaaccacaaaactggttgtgtacgacaaaaaaccggcagccaacgcgaccacatttctgacaggtctgccgctgctgaacaaaggcaactacgctgacgtgatgattttcttttgtccggacctggttaacgtgggttgcctggacaacaccgactcagacgtgacaagcagttactctaaatcagttaccattggttttcagcagacagaaggcattagcattagtaccgaaacatctatggaactgtcaatcgaaatcgttaaagtgggtttcaaactgggcgtgagcatgaccatgagtaacacatggtctaaatcagaaaccgaaacagttggttaccagctgccgggccgcaaaatggcatacctgtaccagggtcagatggaatctattattctgcgttacgacccgtcaaaacaggcatacgaatacgtgaactcttcactgaacaaatttctgaccaacgccgttaaaaccacagaaaaaccgattattctggaacaccaccaccaccaccactaataagaattc

SEQ ID NO: 873 - DNA, 1151 bp, Artificial sequence
  Optimized for E. Coli
ccatgggcaacaaccagctgaaagactcttgtctgcagaccgcgacagctggtctggttgtgcagacctactgcaaccaggttgctattcagccggcatttaacctgccggactcagttaaaacaaaaatgccagacgtggacgcatacctgacagcagcccagacaaacgcgaaccactacctgcgtaacgtgcagccgcgcattattgccgttattgcggacgtgggtggctacagcagtgaatttggctctttttacggtctgattgaccagaaaattcagcagtggaaaaccggctcagacgacggtaagaaagacgccctgctgctgctgaaccagctggaagttgacctgcagggcaaactgagcaacgttaaaggtgtgcagtctgacattaactcatttcagacaatggttaacctggacacatctcactttaacgaagcctttcagtcagcgcaagtgattattggtggcaaccagggtgcgattgcggcttacaacgaacagattggcagcctgaacaaacagattgcaggtgccagtgcgggcgttggtctgtctggcctgtcaattattggtggcggtattctggtgtgtgttggtgtgtttgcttcttcagtgaccggcggtctggcaacgggcctggttgtgggcggtgcagccctggttgtggttggtgctggcggtctggttgctagcagtattgcactggtgaacctgattaacgctaaagcaaacctgattcagcagaaagttgccctggaacagaacctgcaggcgctgaccacatttaaatcttcaattagcgacctgaaagacagcgcggctagtgcagcccagcagctgaccaacatgcacaacgcctggagttttctgggccgtaacctgggtgaagtggttaccagcgtgcgcaacgctcagacatacagtgaactgccgattgtggttcaggcatacctgaacaccgcggcttctcagtgggaagacgttaaaggctcagtgaaaaccattgaacgtcagatgacaggtgttagcaccagtacactgaaagacggcaaaggtaacccggcacagctgacaaaacagagcattattaactacgttagtcacgcagcccaccaccaccaccaccactaataagaattc

SEQ ID NO: 874 - DNA, 1151 bp, Artificial sequence; identical to SEQ ID NO: 873
  Optimized for E. Coli

SEQ ID NO: 875 - DNA, 1358 bp, Artificial sequence
  Optimized for E. Coli
ccatgggtagtcagtgttctggcgaaccactggcacagaacatgctgtgtgctccagacgaaggtattgtgccagacacaggtgctgacctgtctgctcagattccagcactgctggaaaaatctagtgccgaaaagaaaggtattttctttccggcgggcgaatacctgtttagtcaggacgttgtgatgacctcttggaacacactgcagggttcaacccagggcacagtgtttcgtggtatttcaccgaccggcagcgccattctggttggtgacgaaacctacacaaacaccgtgacagacctgacagtttctcacattatttttgacaacgcgcgtgtgggtttctacggtcgtaaaaaccgcattaacctggcatacaacgcctttgttaacacccgcacagccaccaacaccggtcagctgaccgcgtcaacaaacccgtacctgattcgtggcaacatttttatgcgtggtaacggttacccgggtgtgggcctgaacacctacggtaacgctccgggcctgattattgaacacaactttctgggtagtccggacaaaatgtctaaagcagccccgtggctgctggacgacaccaaagccctgctggaaaccatgctgacactgcgtgaacagggtaaactggcttttgacgacacacaggacaaatttgttgcaggctggtactctacctcaaacctgcgtgacggtacatttcgcaacaactttttcagcggcagtaccaactctaaactgtacaacccggacaccggcgctgaagacattacacgcgaccacgcagtgtacattaaacagtacgacaaagttgtggttacacagaactactttggtggctggccggaagacgctagcggtcagctgaaatttcgtaacgcaaacggcctggtttttgcggctaactacctggacaacattagttttaacgcacgtccgtacgacaacaccgaaccggcgtggtggatcatgaccaacacattcatcttcaacaactacgttaaaaacggtattattaactactggcagaacttttacgacacagcagacaaatttattaccgtgacagactacctggtttttagcaacgtgtttgacgttgaaaacaaaaacgactgtctggtgtcaggccagtctatttcactgagcgaagaattttacgaatcaaacaaccgtttcagcgacggtaccgacggcgtggttacatgcggcgttatgaacccgctgagcctggacgacattaccgctcgcctgccggactacgcaagtgaactgctgaacctgcagccgctgaaaccgggcgcagaccaccaccaccaccaccactaataagaattc

SEQ ID NO: 876 - DNA, 1358 bp, Artificial sequence; identical to SEQ ID NO: 875
  Optimized for E. Coli

SEQ ID NO: 877 - DNA, 830 bp, Artificial sequence
  Optimized for E. Coli
ccatgggtctggtttctatggaaaaatacccggcggactcaattctgaaagactacccgctgggtatttacgacaacattggcattaacctggtgaaaaaatgggaacgtgctctggttagctttcacgtgcgtaaaccgtttcaccgctttgaagttgaaaccgtgggtacaggctttctgtttgaaaacgaaagcgttgtgggtatttacaccgcaagtcacgttattaaacagattatggacgacaaaacccgtacaattcgcattaacgacagcttttacctgctgagtaacgttaacgtgttttacgaagacacacaggactacgcgattgttgaactgccgaaagaagctatgaacggccagcgtattgtggcatttccgctggcccagcgcaacaacctgaacctgaccaaaagctttatgatttttggttacccggcaaacaaaaacgtgctgcgtctgggcaaacagcacctgtttaacacactgaacatttttcgcaacgactttaaatacgacaccgaaacagaagacattttctttgaatttaacaagaaagacaaatacatttacgaaccggacagcagttttaaaagtctgccggcactgaacggcatgtctggctcaccgattgttcagattgttgtgaacaaaaacaccgaagccctgacactgcgtgtgattggtatttttaaaattcaccgccacaacaacaaagaaaaatacctgattggctctaccctgacaaactttgccgacgaaattaacaccatgatttcactgggcgttctgacacaccaccaccaccaccactaataagaattc

SEQ ID NO: 878 - DNA, 3839 bp, Artificial sequence
  Optimized for E. Coli
ccatggcaattgttgacttttacggcaacagtgtgcgtctgggtagcggcgttagtcgcgttgtgaacaaatctgcactggttggtggtgttgctaccggtacagcagccgcggaagcatttaacattaacggtgcatttacactggcgggtggcgctggtgacgaccgttactacagcgtgagtcgcgacagtaaaattgttgaaaaagcaggtgaaggcattgacaccgtgtacgttatttctaactacgttatgccgggtcacattgaaaacctggaaattggttacgcctcaggcgtgattggtaacggcctggcgaactacattaaaggcagcctgctgtctcagtcaattgacggtggcgccggtaacgacattctgaccggtggcggtggcggtgacgcgtttgtttttcgtgctggttctggctacgacatgattacagactttcacacaggtccaacagcagacgtgcgtattgcaccagaaaccgttcgcctggctggttacgaacagtttagcagttttgcacagattaaagctgcaatgacccaggttggctcagacgttgtgctgcgtctggacgcagacaacgccattaaatttgcgggtaccacagtgagtgcttttacaaaagacaactttgaactgcgctttgactctacccagctgaaagcgagctttagtgacgactttaacgctctgagtctgtgggacggcctggcaggcggtacatggcgctctgactacggttggggcggtgaccgtaacgcgacaatggctcgcaccctggccggtacaggcgaaaaacagctgtacgttgactctggcctgctgtcaaaagaaaccggtcaggcgatgggcctggacccgtttagtgtgaaaaacggtgttctgaccattcacgctgctccaacagctgcagacctggtggacgacctgtctggttacaaatacaccagcggcctgctgagtacacgtaactcttttacccagacatacggctactttgaagcacgcatggaagtgccagctggtaaaggcgtttggccagctttttggctgtacaccacaggttcttcaggctcagaactggacgtgatggaaagccacggcggtgaccagtacggtgttaccacacacgacctgagcaccggtacagacgtgccgctgaccggcacagtgtttgttccggacctgtcagaaggttttcacacctacggcgtgatgtggacaagcgaaaccgttacatggtacctggacggcgtggcagttcgtacaattccaaccccgccggacatgcacggtccaatgtacatgctggttaacctggcaattgacgccaacgtgcagagcgactttgttggtgccgacatgcaggtggactacgtgcgcgcttacacactggaagctgctccagctgcagttgaccgtacagctggtaacatgattagtggcaacacagtgtctggcggtggcgcgattgactacctgagtggtaccacaggcgcggacaaactggtgggtgttgctggcaacgacacctactacgtggaccacgccggcgaccgtattgttgaaaacgcgaacgaaggtctggacacagttcgcaccggtattgactgggcgctgggcgctaacctggaaaacctgacaatggttggttctgcaattcgtggtacaggcaacgaactgaacaacgtgatttcaggcaacgctctgaacaacattctgagcggtggcgcaggcaacgacacaattgacggttttgcgggcgctgaccgcatgattggtggcaccggcaacgacatttacgttgtggacaacgtgggtgacgttgtggttgaactggccaacgaaggcgtggacgtggttaccgctagcgttgactactctctgtcagcaaacgttgaaaacctgaccctgacaggtaccgcaattcgtgccaccggcaacgacgtggcgaacattctgaccggtaacgaactggacaacattctggcgggtggcgctggctcagaccgtctggacggtggcaaaggtgctgacgcaatgagcggtggccgtgacggtgacacctacattgtggacaacgttcgcgacgtggttattgaaaaagctaacgaaggttgggactcaattgtgagcagtgttgactacaccctgagtgcaaacgttgaacagctgacactgtctggcaaagctattcgtggtacagctggttctgctgctgcttttctgtacggtaacgaactgggtaacgtgctgaccggtggcgcgggtgctgacacaattgacggtaaagccggcaacgaccgcattattggtggcgcgggcaaagacaaactgaccggtggcgcaggtgccgacacatttgtttttggtgcgaactttggcgctgacacaattaccgactttcgtattggtgaagactcaattgactggagcgcactggttccgatttacggtgccccgaaaattaccaacgtgggccgcaacgtggttgcgacatttggtaccaaagctaacagcattacatttacaggcctggacgcagcaaacctggtggcaggtcacgtttttgacgccctgaacccgctgggtaacccgtttccggaaccgaccgacgaaccgacagacgaaccaagtgcaccagtggcaccgccggttattaactacccgacactgaccggtacaagtggcgacgacacccacattgtgtctgttgctgacacacgtattgtggaacaggttaacggtggcattgacaccgttatgtcttcactggactacattctgtcagccaacgtggaaaacctgcgcctgaccggttctgcgatttcagctaccggtaacgaactgggcaacatgctgagcggcaacaccctggacaacattctgattggtggcgctggtcacgaccagctgattggtctggaaggcgcagacattatgcgtggtggcaccggtaacgacagctacagtgtggacaacgttggcgactcagttgcagaactggccaacgaaggtaccgacagcgtgaacagcagtgcggactacaccctgacagctcacattgaaaacctggcactgctgggcctggctgtgcgtggtacaggcaacgacctgaacaacgttattaccggtaacctgcaggacaacattctgagtggtggcggtggcaacgaccgcctggacggtcgcctgggtgcagacacaatggcaggtggtacaggtgacgactcttacattgtggacaacgcacgtgacctggttgctgaagctccgggtcagggctgggacatgatttggtcttcagttgactacaaaaccacagccaacattgaacagctggtgctgaccggtaacgcgattcgcggcaccgcaaacgccacaggtagtatggttattggtaacgagctgaacaacattctgacaggtggcattggtaacgacatgctggacggtaaagcgggcaacgacaccatttctggtggcggtggcaatgatcgtattattggtggcgtgggtaacgaccgcatgaccggtggcggtggcctggacacatacctgtttgcatcagactttggtaaagacgtgattacagactttgacgttcgtaaagacaaaattgacctgagcgttattagtgctctgtaccgcccgaccattagtgaagacaaccacaacgcagtgctgcactttgacaccaacacaattaccctgctgggtgtgtcagttgacgacgcacagcagaaccagtttgactggctgtctatttcactggcaagcccgtacgacatggcccaccaccaccaccaccactaataagaattc

SEQ ID NO: 879 - DNA, 1790 bp, Artificial sequence
  Optimized for E. Coli
ccatgggtaacggcaaagtttacgtgggtcaggttgacaccgacccgacaattccgtctaaccagattcaggtgtacattgaaaacgaagacggttctaaagttccggtgtcacagccgctgattattaacgcagccggctttattgtttacggtggccagattgttaaaattgtggcggacagcaactacagtatggcggtgtacgacgcttacggtacccaggaattttactttccggacctgctgaaatacaacccggaccagtttattccggaactggctgacccggactcaaccgttattattgcaggcacagaagcctctaaaatttcatacgcggctaccattacagcgaacatgaacaccgtgcaggaactgattgcagcccacgttccggacaacattggtattgtgattacagctggctactacgacgtttttggtaaacgtgacgtttgggtgcgctctaccgaaatggacctgccgtcaaaaacaccgattcagctgaacaaactgagcgttaccgacgcaaacggtagtgtgtggaacctggacattagcagtggttacatttacattgacagcattggcgccaaaggtgacggcaccacagacgactggtaccacctggaactgtgttttaaaaacgcggaacagggtaccaaccgtattgtgaaaggcaacaaaagcgcttactttttcagcaaaccgattctgctgaaaacaggtcgccacctggaatttaacgcaaaatttggcgttgacattacctacggtggccagctgctgtcttcaacagacgcgccgtctgctaccacaccgattggttcaggctttaccagcacatttagtgacaaacaggcgcagattgttgtggctcacaaagacggccagtttgcccgttactggtctgtgaaaaactgttacattaaaaacgactcaggcaccagcagtacatttggtatttactgcccgtttggcaacgcatttgacctggaacacgtgtggagcattggtggcctgaccggttttgacgcccgtaacatttacacatactctttttcaggctgctactttgcggctccggttggcattaccggtacagttggcattaacgtgaccccgattcagaacggtctgggctctggtacctcaggtacatacgaacgcgttggtattgtgggctacaaatacagttggatttttaccgaaatgaactacaccacactgacaagctgttacagtgaagacacccgtacacgctacgcactgtttctgacccgttgcaacggtattaacattaacacctacggcattgaaaacctgacagttgtgtctggtgacggtcgcctggcagcaattgcagactctcagatttcaattaacgcactgcaggcctcatacaacattaacctgagcggtgttagtgcgattaccgtgacaggcaacagccaggttaccattaacgacgtgtttattgttgctgtgggtagtccgtacgttccgctgcagaccgacaacacaagccgtgtgcgcatgtttggttttaaaagtaccggcccgacaccgctggttaacattaccggcctgcagaccgtgatttacggtgaccagggccgcaccgaatgtgcaaaatttccgggtaactggaacggtggctttctgcgtattggtgacgtgcgcctgtgggacgacggtacaggtctgcgtattaaacgcggtacagacccggcaaacgttagtgacggcacagccctgcaccaccaccaccaccactaataagaattc

SEQ ID NO: 880 - DNA, 1790 bp, Artificial sequence; identical to SEQ ID NO: 879
  Optimized for E. Coli

SEQ ID NO: 881 - DNA, 548 bp, Artificial sequence
  Optimized for E. Coli
ccatgggtagcctgacaccgggcgttatttgtatgtttacaggtggcaccattccggacggttggctgctgtgcgacggcaaaaacaacaccccgaacctgattgaccgttttattctgggtgcaagcagtgccgacacaaacattattagtgaaaccggtattagcggcagtcacccgaaaaaatactttacaaacaccacaaacggctcactgattacagcgagcgtgaccattgctccgcacacactgaccattgcagaagttccgagccacacccacaaaattgtggactacgagggtgactacctgcgcaacgcggacggtggctctcgttcaggtagcgaccgctacccggtttcaacaggcaccaaacagccggacctgaccacaaccagcgtgggtggcggtggcagtcactctcacaacggtagtctgacaaaccagtcttcacactctcacggcattaacattaacatgccgtactacaccctggcatttattatgtacgttggcgtgcaccaccaccaccaccactaataagaattc

SEQ ID NO: 882 - DNA, 395 bp, Artificial sequence
  Optimized for E. Coli
ccatgggctacagcaccgcgctgaacccgaacaacagtctggaaaaacagtgtgaaaaagaaggtggcggtagctacttcatcaaaaacgcacacatcaccttcatgaacgccacagtgatgtggaacccggaaaactctgcgggtgactggaaagtgcacaacgctatcaacatcaaactgaaatacaacgttgaaaactcaaccaaagaagcatggtttggcgtgtttggtgaaaacgttgcgcgtggcagcagtgcttttggtctgtcttcatttgcacaggccatgtttctgctgaaagcaccggttgacgtgtgcgttaaaggcaaatacctgcgcggtattgaaaacaacacagccagccaccaccaccaccaccactaataagaattc

SEQ ID NO: 883 - DNA, 395 bp, Artificial sequence; identical to SEQ ID NO: 882
  Optimized for E. Coli

SEQ ID NO: 884 - DNA, 1256 bp, Artificial sequence
  Optimized for E. Coli
ccatggaaaccaaacaggacaacattgacattagcagtgcactgcgtaaaattggcgcccacagcaaactgacccagacatttattgacggtgcactggccagcccgaacgttcagctggaagaagtgccgagtctgaacaccacacagtttctgattaaacaggacatgaaagaatggtcttcagaactgtacccgaaactgattctgctgaacagcaaaagtaaaggcttcgttaccaaattcaactcttactacccgacactgaaaggttttattgacaacggcgaagacaaagaaggtgttaccgaccgtctggaagtgctgcaggacatgaccattacaaaccaggaatcagttcagcgccagattaacgaactgaccgacctgaaactgcaggtggacaaaaaactgaaaaacctggacacagacgttattaaagcccagagcgtgctgaacagtgaaggtaccggcaaaattgacaaactgaaaaacgaaatgctggacaccaaaaaatctattcagaacgacctgcagcagattgctctgctgccaggtgctctgaacgaacagggtctgaaagtttttcaggaaatctactctctgtcaaaagacatcatcgaaccggcagcccagaccgcggttgtggcttacaacaaaggcaaagaaattaacaacgcaattgtggacgccgaaaagaaagcagaacaggaagctaaagaaaaaggtaaaagcgcgattgaaattgaagcggcaaagaaagaagcacgtgaaaccatcgaaaaatctaagaaaggtgaaatcgcagccgcggctgttaccaaaacaaaagaatacgacctgatgaaagtgattgacccggaaaaaattaagaaaacctacaacacattcgcggaaattaacaaactgacagcagaacagcgcgcctacctgaacgacctggaaaaacagaaccagaaactgtacgacctgaccacaaaactgaccgttgcagacctgcagaaaagcatgattctgtttatgcagaacgacctgcacacatttgccaaccaggtggacggcgaaattgaactgatgaaacactacaaagaagacctgggtctgattaacaactctattaccaaactgtcaacagaagtggacgctaacaacacccagtctcagaaagacacactgcgtcgcctgaaatcagttaccacacagctggaagaacaggtgtacaaatttcaccaccaccaccaccactaataagaattc

SEQ ID NO: 885 - DNA, 1256 bp, Artificial sequence; identical to SEQ ID NO: 884
  Optimized for E. Coli

SEQ ID NO: 886 - DNA, 1175 bp, Artificial sequence
  Optimized for E. Coli
ccatgggccaggaacagaccgcccaggaacacaaaattgaaaactacgcgctgggcccggacggtctgaagaaagcactggccgaaaccggcagccacattctggttatggacctgtacgctaaaacaatgattaaacagccgaacgtgaacctgtcaaacattgacctgggtagcggtggcggtgaactgattaaaaacattcacctgaaccaggaactgagtcgtattaacgctaactactggctggacaccgcaaaaccgaacattcagaaaacagcgcgcaacattgttaactacgacgaacagtttcagaactactacgacaccctggttgacacagttaaaaagaaagacaaagtgtctctgaaagaaggtattggcgacctgattgacaccattcacacaaactcaaacgacgttaccgaagtgatcaaaatgctggaagccttcaaaacaaaactgtacaccaacacagttgactttaaaaacaacgtgggcggtccagacggtcagggcggtctgaccgcaattctggccggtaaacaggccctggttccgcagctgcaggcggaaattgaaaacctgcgttctacacagaaatcacactttgacaacgttctggcatggagcattggcggtggcctgggtgcagccattctggtgattggcaccattgcgggtgctgttgtgattgttgtgacaggtggcacagctacaccagctgttgtgggtggcctgacagctctgggtgctgctggtattggcctgggtacagcagccggtgtggaagcaagcaaccacatgaacagttacaacgaaatctctaacaaaatcggcgaactgagtatgaaagcagacctggccaaccaggcggttatttctctgaccaacacaaaagacaccctgacatacctgtaccagaccgtggaccaggccattatgagcctgacaagtattcagcagcagtggaacaaaatgggtgcgaactacaaagacctgtacgacaacattgaccagatgcaggaacacaaactgtcactgattccggacgacctgaaagcggctaaacagagctggaacgacatccacaaagacgctgaatttatcagtaaagacatcgcattcaaacaggaaaaaaccaaccaccaccaccaccaccactaataagaattc

SEQ ID NO: 887 - DNA, 1175 bp, Artificial sequence; identical to SEQ ID NO: 886
  Optimized for E. Coli

SEQ ID NO: 888 - DNA, 1076 bp, Artificial sequence
  Optimized for E. Coli
ccatgggttctgaatcaaaaattgaacagacctctacagaagacattagcctgagtgttaactcagaaaaaatgaagaaagcactgcaggacgccggcgtgtttgcgaaatctatgaacgactactcatacctgctgattaacaacccggacgttaactttgaaggtattgacattaaaggctacacaaacctgccgagccagattgcacaggaccagaaaaacgctcgtgaacacgcaaccaaatgggacgcccacatcaaaaaacagctgctggacaccctgacaggtattgttgaatacgacaccacatttgacaactactacgacacactggtggaagcgattaacgaaggcgacgctgacaccctgaaagaaggtattacagacctgcagggcgaaattaaacagaaccaggcgtacacccagaacctgattcaggaactggctaaactgcgtgactcaattggtgaagacgttcgcgcgtttggtggccacaaagacattctgcagagcattctgaaaaaccaggctagtggcattgacgaagacgaaaaacgtctgaacgacgttctggaacaggtgcgccactttaaacaggtggaaagcgacggtattattacagtttctgtgccgtcaattccgacctggattgcaggtggcgttatgattggtgtggcccgtgacaacctgggcacactggaaccgctgctggcgcagctgcgtcagaccattgactacaaaattacactgaaccgcgttgtgggtgttgcttacaacaacattgcagaaatgcagaacgccattggcctggcgattaacgctctgacctacatgagcgcacagtggcacgacctggacagccagtacagtggcgtgctgaaccacattgaaaaagccagtcagaaagcggaccagaacaaatttaaatttctgaaaccgaacctgaacgccggtaaagactcttggaaaaccctgcgcgcagacgcctttacactgaaagaaggcattaaaaccctgaaaatggacccggtgagcagtaaaaaacaccaccaccaccaccactaataagaattc

SEQ ID NO: 889 - DNA, 1076 bp, Artificial sequence; identical to SEQ ID NO: 888
  Optimized for E. Coli

SEQ ID NO: 890 - DNA, 665 bp, Artificial sequence
  Optimized for E. Coli
ccatgggttacctgatgggtattgacggcacaatgggtacaggcaaaaccctgtgtatgtctgttctggcacagcactttcgtcagcagtctggctgcacactgtactcaaactacgaactgaaacactcaaaactgatcaccaacttcgaaatgttcctggacgtggcgcagcagccgagcagtattatttgtctggacgaagctcacacagacctggacagccgcagtgttaacacaaacgtggcgaaatacctgacccacatggtgttttacctgcgtaaactgcgctgtacactgatgtttaccagcccggacattgctaacattgacattcgtctgcgcctgattatgaacgtttactgcaaagcaaagaaaaacaaaaactacttcaactacagcctgtggaacgcccaggacaacaaaccgctgcgtagtctgcgcgtgaaccagcgtaaaatttttgccattggtcaccagatttacgacacaaacggcatggttgtgccgatggactttccgcagaccaaagaaggttacctggacattctgaacctgctgaagaaagttagcaaccagtactacgcacaggcctcttcagacgctggtcagcaggccaccggcgcggacgctgtgcaccaccaccaccaccactaataagaattc

SEQ ID NO: 891 - DNA, 965 bp, Artificial sequence
  Optimized for E. Coli
ccatgggttttaaaaacgacatccgtgaaaaagcagttaaattcggtaaatctaaaacatctgaccagggcctgctggacgcactgcacctggaactgccggacgttaaagcggtgatgtctgcttacaaacgtcagctgccggaatttgacgactttaaccgcaaaacacagctgattctgaacgcgtctaaagaatttggccagctgaaaccggctaaacagcgcaaattttcaaaaccgggtctgaaagaaagcggcgttagtggtggcaacttcatctactctaaaaaatcactgcaggactttgcagcccacgcgggttacgttcacaacgaccactacggcgacgaatttgtgaacctgaaagacaacaaccgtaacctggctgacgaacgcctgtttccgggtattagcctgattaaacgtccgaaactgagtattgtgaaagaccaggaacagtggaacatgcagcagagcgacgaagcagaagcctacaaaatcaccgacatcgaagcattcatcagtggtattcgtgaaatgtacggcgaagttaacccgctgcacccggtgattgaaagcctgattcgcaaccacattgttaacaaccactacattctgccgacaatggcaggtattgctggcctgcacgcagaagtgcaggccctgaacaacctgctgacactggaagacgaacgtgctggtaaagccattggcagtcgtaaaatgggcgaatacatgcgcgacattctgaaaagcagtatttttacccagcgcctgaccacaaaacaggcaggtgacgactttgcggcttgtcacaactgctctggcattctgtcttcaccggttaacgtgattaccggtaaagtggaaagcgccggcagtaactttagcagtaccctgtcacgctacaaaacatctcaggaatcaccgattcaccaccaccaccaccactaataagaattc

SEQ ID NO: 892 - DNA, 1112 bp, Artificial sequence
  Optimized for E. Coli
ccatgggtattctgaaaaacgaaaacggtattacagacggcaactcagttgtgaccgcccacacagacgacaaagcaagcgcccagtgggttaacgtgaccgacgtttgtgtgaacgttgtgagcgttagtggtcaggcgccgctgctgtacgctaacggcctgaacatgattgcggttcgcgtgtacatgacctcacaggacattaacgaaaaaacaattgacgacattgacgttaacgaactggttggtgctgtgacactgattgactacgacaccggcgtgccgtttacaaaaattgaccacccgccgagcctgaaccacattaccccgggtggcacctactgcacagtggcgaacaaatacctgtctggttcaaactttattaacccgggcatttcaggttacggcaaacgttacattacactgtactttgcatacaacggtaccagcagtacaagcgttcgcattggctgtaaaattaaaccgacctacccggacaaaggtgccgacggccgttacgtgtacaacgaagttgtgaacagtattaacggtgacacccactgcccgaccacaccgatcaaagttacagtgaaaaaattcaaagactctgacgttaccgaatcacacctgtacagcgctaacgttagtaccggtaaatctccgaaccgtgacatcttccgctactacatcaaattcagcgacggcgttattacccacgtggacctgccgacatcttcacagccgggtgcaccgaccggctactttcactacaaacagacaggcaactacaaagacttttgttgctttaccgacgacaaatttgacgttgacccgagtgccaaatggaccacaccgacatttaaaattgacaacagctggagtgactctgttaccttttacaaccacgaagaagacggtgtgtgtatttttctgtaccgcttttggtacggcgcgctgtggtcttaccaggaatggaacctgggtgctatttttaccctgtacgacgaatacggcaacgcatgcaaaattagtgccattcgtgacgaaccgaacgacaaaattaaattttctgttgtgaaccaccaccaccaccaccactaataagaattc

SEQ ID NO: 893 - DNA, 4997 bp, Artificial sequence
  Optimized for E. Coli
ccatgggcaaccgtgacaacgacagcaactttttcacacaggctggttcttttacctcagcaattagcggtggcgtggacccacgtacaggcctgtacaacctgagtattaccctgggccacattaacggtaacaaccagatgggtccgcagtttccgattaccctgagctacagtccgcagtctcagggcaacatgggttttggcacaggtgtttcactgggtgtgagcacatacgacaccagcagtggccgtctgtctctgtcaaccggtgaacagtaccagacagacgaaaacacctcttcagttacagtgaaacagaaaaaactggacaacttcaaattcgaaaaacacggtggcgaaagctaccgtgtgacacacaaaaccggcgacgttgaaattctgcgcggcgaagactacggtagcagtctgaaactgccggtgcgtatgattaacgcagccggtcacagcctgagtctggcgaccgacaacaacaaccgcctgatttctgtttcagacgaatcttcaccgctgctgtgggtggcttacgacgaccgcgttaccctgacattttacccgggcacccaggaaaaatacagtgtgattctgcagacaaacaacgacctgctgaccacaattacccgtcgcaccacaggtgaaccggacctggtttggcacattcagtacgaagacaccggcttttggggccagtgggcgacagctatgaccagcccgagtggcctgcaggacacagtgatttaccgttgtgacggttacacccaccgctttccggacagtgcaccgcagtctctgcgtaacaacccgatgccgtacgttacgaaacgtacactggcaccaggtgctggtcagccaattcaggtttcagtgtactcttactcagactacaactacctgggctacgacagcggtgttgactgggaagcaacccaggacaacctgtacaactgcctggacaactacatttacagcagtgttgaaacacagggcgtgggtattgccagcaaaaccattacacgtgaatacaactcataccacctgcaggtgagcgaagaaacctcttcaggcagcaacagtgttctgaaaaccacagaatactacgcgaaactgggtacaccgtttgaaaaccagccggaacagtttcagctgccgcgtacaattaccacaatgtggagtgaaggctctaccggtctgaaacgcaccgaaacagtgattacagcttttaacgaatcaggcaacccggtgagccagaccgacgcagacggtaccgttacacagtgggaatactacccggccaacggctctgacaccgactgtccgccggaaccgaacggttttacacgttttatgaaaagtgaaaccgttacaccgcgcaaaaccgcatactctacaccggcacacaaaacagcctacacctacgcgacatttgaacacgcatcaaccgacgttagcgccctggtgatgaaagcgacagaaaaacactttgccgacgacgtgctgctgaaaaccatttcatgccagtacggcaccaaagcggctaacacagccggtgttatgaccaagaaaaccacaacctacccggacccgaccgacaacaaacgtgaatacacaaccacagaaaccgtggactttacagacccgggcgttaacggtaacaacattgacgcttgggtgagtgcatacaccctgacatctcacgacggtctgaccgtgacacgtagtcgcacagtttcttgtatgaccggccgtctgctggaaagtaccgacaacaagggtaacgttaccgcatacacatacaactctctgggctggctgacaaaacgcgttcacgtgaaagacaccgcctacgaacacaccacaacctacgaatacaccgtggacgccacatctggtgtgttttacgcgacaaccacagacccgagcggcaacaaagtgcgtcacggtctggacggcatgggtcgcctgctgcacattaagaaaaacgacgttgacatggactcaaaaaacagcgaaccggaatttctgatgcagcagcagacacgcgacgcactgggtcgctcactgacaggtagcacacacgactaccagcaggcagctaacaaaaacaacccgacccagacagtgacccagacacagcgttacgacaactggggcctggtttctgaatcagtgagcagtgaaggtgttaccacatacaccgaaacagttctggtgctgccgccgaccggcacaaactgcatttggcagctgcgcagttggcagtctggtggcaccgacacaagtggtattaccgtgaccacactggacgacaaccacaactctgttaaaacagaactgtacccgaaaaacgcgcaagtgggcaaaaacacaccgtacagtgttacctactctgaatacgacggttggaaccagctgcgtagccagaccgacgaactgggccagaccacaacctacaaatacgacgactggggtcgtccgacaattacaaccctgccggacaacacccagacacaccgcgcgtacgtggctttttcttcagcaaaactgccggttagcattagtgtgctggacagtaacaacattccggttccgggtgtgggtggcacccagacatttgacggcctgggtcgtctgaaaagtaccattattggtggccgtcacgctcgctactcttaccagtttgcataccagcgccacccgaccgtgatttacaacgaagcaggtaaccaggaagtttacacatacattaacgcactgggtgaagctccagaatcactgcgtgccagcggtgttgacattaacgtgtcacaggactggacatacaacccggttaccgcggctatgatgaccgcgacagaagacaaagacaccgaaaaccagcacagcctgcgctacggctacgctacaagtggtcagcagacctctgttacagtggaaaaagaaggcgacatcaaagaaaaatctaccaacctgatggcccgtaccattggtggcacagcgacaaccgtgcgcgactacgctggtggcacccagacactgaccctggacattctgggtcgtgcaacagcactggacgacgctgacgttagcagtacactgacctacgacggcctgggtcaggttacccagtggacagtgaccagcaagaaaaaccactacacaaaaacaaccacactgaccctggacgaatacggtcgtgaaacccagcgcacaattgaaacctgggacgctcgcaacaccctgaaagacacactgaccgttgtgcaagtgtggagcaaaaaacaccaggttacacaccgtaccacaacccagacaaccgcgggtaaaacagtgaccctgcgcgacgaaagctacgactttgctccggaacgtggctggctgatgcgctacacagtttctggttcaaccccgccgcaggacgaaaccggtaaagcactgagtcgtcaggactttacatacgactcagtgaccagcaacatgacaaccaaatctgttacatacaccgacgacacaaccacatttaccatgtacctgtttgaaaacaaagacgaccagtgtcagctgacaggcattcgtacagacaccggtaccacaacctcactgaaatacgacgacgcaggccgtctgacccaggacgaatacggtcgcatgctgagctacgacgccctgggtcgcctgtgcaaagtgaccctgaacggctcaacactgacccgttaccgttacgacgctggtaaccagctgtctggtcagaccgttggtgacacaaccacacgttactactacggtaactctacactggcctacatggaagacgacgcgaccccgaaaaacgcagccctgctgacaccgcacgcacaggttcgcaccggcaaaaacgccggtatttggctgacctcttcagacatggcggaaagtgttctgtctgtgaccgacggtaccacacaggaaaactacgcttacacaccgtacggcgctcgtaacggtgcaagcagtaacgacgaagcgattgctgtgaccggctacaacggtgaacgcctggacggcacactgaaccagtaccacctgggcaacggttaccgtgcatacaacccggttctgcagcgctttacctgtccggacagcctgagtccgtttggtgacggtggcattaacccgtacatttactgcgaaggcgacccggtgaaccgtacagacccgaccggtcacctgtttaccgaaattgctctggctgctcgtgcagcatggaaagctattcgtgacagtgttctggtgcgcaaagttaccgacgcggctggtggcatttggcacaacggtaaaacaatgaccgactctctgtttggcaaacgtccgccgaaaaacagtctgggtcgttcttttcgtgacggtgacacagcagctggtagtcgtaaagaaccgcgcctgcagaaagaagttgactacaaagtgacagaagcatctcgttcaccgatgttcaaattcaacgacaacatccgcaaaaacccggaacagctgtggtcactgcacgaagacaacggcaaatacatttacaacagccacaccaaagttaacggctacggtgtggaaaaagcctacgttaacctgaagaaaatttctaacaaaccgatcgacatcatcagcggtagtcacggtggcaacctgggcgagggtaactgggtggaaatttttggcccgaacgcgaaacgtgaaggtgttattcgcaacccgtcatacctggaacacaaatttctgatgcaggacctggctacactgaagaaaaacaaaggtctgaccgaccgcgtttacaacattaaaaacctggaccgtaacgaactgaacaacattctgcgcaacccgaacaccaacgtgattctgggctactgttactcagctaacgacaactacatggcaagcgttgacaaccgtatttcttcactgatttttggttggcgccaccaccaccaccaccactaataagaattc

SEQ ID NO: 894 - DNA, 2663 bp, Artificial sequence
  Optimized for E. Coli
ccatgggtggcattaccccggacaacccgaaaacacaggttcacaacaacggcaacgtgccggttgtgaacattgcagccccgaacaacgccggtatcagtcacaacacctacaaagaatttaacacaggtattcagggcgccattctgaacaacgccacccaggcggttaaatctcagctggcgggccagatttcagcaaacgccaacctgcacggtaaagcggctgaactgattattaacgaagtgacaggcagcagtcgtagtgaactgctgggtcagctggaagttgccggccagaaagcgaacgtgatgattgccaacccgaacggtattacctgtgacggttgcggctttattaacacatctggtgcgattattaccacaggcaaaccgcagtttgacacccagggcgctctggaagcactgaaagttaccaagggtcagattacaattggtggcaaaggtctgaacggccagtctaccgactacgtggacattatttcacgcgctacagaactgaacggtaaaattcaggctaaaaacctggcatttacacagggcgcaaaccagattagttttaaagacggtaccgccaaaacaattgctggtgaaggtaaccgtccacagctggcagttgacaccaaagcgctgggtggcatgtacgctaacaaaattcgcctggtggcaacagaaaacggtgttggcgtgaacctgaaaaacattaccagccaccagcaggacattacactgagtgctaacggtaaaatggaactgggcaacattaaagcaaaaaccgacctgaacgcgggtgctaaagaaattaacattggcccgaactcaccggttcaggccgaacgtgacattgtgctggcgtcttcaaaactgagcaacaaaagcagtgttaccgcgggtcaggacatgcgcatttacggcgacacaatttctaacgcaggtgcacaggctctgctgcaggcaaacaaaaacatgtggattcagaaaaacgcggaaggtggcaaaaacgaactggttgaaaacaaaagcggcaccattaaaacaaacagtggtgacctgattattcgtacccagaacctggtgaacgaaaaagaaaacgttcaggtgaccaaaacaaaccaccagattaactcaaacgccggttacggcgactacccgaaattcaaattcgacttcaacaaaccgatcctgattgacagccgccacaaagacattaaactggaacacgcggactttgtttcaaacgtggacagcaaacaggccgttattgaaagtggccacgacgcgtacctgtacggtgaaaccctgaccaacaaaaactcttcaatctctgcaaaaaacaacctgattctgaccggcacacacctgaaaaacagtggtgtgtcttttggcctgctggaaaaatacaaagaatacttccgttcagaaaaccgcgaaaacattctgaaccgtgacattctgatttggaaaaacaactctgtttcacagagcattctgagtgccaaaaactctctggtggcggacttcaaagaaagtatctctatcaaaaacgaactgccgagcgaagctaacaacattaaccaagtgatttacggtaacaactacgcagccctgaacgctaaaaacattctgctgcacgcaaaagacgtttacctgagcaacgaaattaaagcggacaaagacgttagtattattgccgacaacgcggttaaaacctctctggctgtgctgaacgcaggcgaaaacatttcaattgcggctcgctacgacattaacctgctggactcaaacctgaaaagcaaaaacatttcactgattagccacgacggtaacgttaacgtgaaaaacagcctgcgtgcattttacccggacaacacccgcctgctgagtaaactggacgcttctgcagacctgtcaattagcaccggtaaagacatctacatcaaagacacactgttcgttagtaaatctaaaaacatcgctttcaacgcaaacaaagacattaccattgaacacacagacgacctgctgaaccaccacaacccgattcagcagctgtcaaccgaccaggaagctaaactgtttgactcactgagcccgacagcaaaactggacagcagtggctcaattctgattaacagcggtggcaacctgagtctgaaccgtgtgaacctggacgctgacaaagacattgacctgtacgcaggttacaacttcaaccagtacagtaaagaatttgaaccgaaccactttagtgtttctaccgtgacaaaagctctgaaactgcagacccacattcgctctggtaacaacctgctgattaacgcacagcacgacattacactggaaggcagtgacatttctacccagggttctacaaacctgctggcaggcaactcaattaacctgctgggtattccgtactttttcgaaaacaacggcgttgaagtgctgaaatacgctctgccggttattgcaattccgccgaacaaaaacatcatcaccacaatcaaagccaacaaagacattaacctgattagcggtgcgtactaccacccgtcacgtagcccgaacaacattcaccaggaccacctgattccgtttaacgaaattgcccagcaccaccaccaccaccactaataagaattc

SEQ ID NO: 895 - DNA, 2663 bp, Artificial sequence; identical to SEQ ID NO: 894
  Optimized for E. Coli

SEQ ID NO: 896 - DNA, 1499 bp, Artificial sequence
  Optimized for E. Coli
ccatgggtatgtcaacagaccagcagtctgctctgcagggtcagccactgaacggtgcaagtgaaccgatcatctctgcccagttcaaatacgaaatcgactacaacaacgcagcccgcgttgtgattaccacaggcctggaccagattccgatggttggttttgtgctgggcgctctggttgaaatcttttggccgagcagtcagcaggacgtgtggagcgaaattgaagcgaaagttgaacagctggttgacgctaaaattagtgaactggtttaccagcaggtgcaggaatctctggcgggtctgcacaacaacctgaacgaatacctgtgggctgtgaaaaacaccaaagacccgaactacattacacagaaatttaacattgcgcacggtcactttattcaggaactgccgcactttcagagtaaaggctacgaactgctgctgctgccgctgtttgcgcagtttgctaacctgcacctgtcactgctgcgtgacggtgtgatttacggcgcaagctggggttggggcgaagacgttcagcgtcacctgcgcgaacagattgttgaaaccattcagcagtacgtgcagtacaccgacaccacatacacagaaggtctgcagaacacacagtctaaagccccgtcaaacagccactacaccgaaccgtttaacacagttaaccagtacattcgcgaaatgaccctgacagtgctggactttaaaaccatgtggccgtactacgacccgacacagtacccgaacccggtgaaaatttacctggaccgtgaaatttactcagacgcagttggtaccgccgacaactcaggtccaattacactgccaagcccgccgaccaaagcaattacaaaaattgaagtttgggcctgggaccgtattgacggctgtcaggtgacctacgaacagggtggcggtccgaacggtgttacacagacaccgcgcatgggcgaccagggcggtggctcttcaagcccgccgcacggtggcgtttttgacctggtgacccgtggtccggttgtgggcgttaaaacactgagtggttctattctgaacgcatggtggtttacctttgacgacggctcaacaagcaaccagctgggtggcaactacccgggtggcagcgaccacagtttttcttacccggacgaaatcctgagttctatcaaaatcatgggtgtgtcaaactactacaaaagcgcagactgtgccgttttcggcttcaaattcaaacaggaacagagtctgccggaaccggccctgctgcgtaccatgtacgtggcgagtccggctaaaatttctccggaagaactggcgcgctgcgttggtgctgaagacattgacaaaacaggcaaactgattcaggaatggagtgacttttaccactgggacaccattcgtcagtctcactgggaccgcattcagacagttgtggactcacagggtaaacaccaccaccaccaccactaataagaattc

SEQ ID NO: 897 - DNA, 1451 bp, Artificial sequence
  Optimized for E. Coli
ccatgggtcagggctcagtgagcagtaccagtctgcaggtttctgcagactcttcagactactacattattggtagcgacttttacaaccactttgtgcgtccgaccacagttgacctggccaaaaacaaagttgtgtacaacaaacagatcctgaccgtttacaacggtcgcattgacaaatggaaaatgagttttctgaaccaggacagcagtggcaaaagttggtttaaatttctgtcttacccggaagcaaccaaaggtgacattaaaattacatacaccacagacggcattaactactcagacagcaaaccgagcctggaacagctgaaaggttacatggtggaactgctgaaaccgattgtttacccggacgacgcaaacaaccaggaaaacgacattgaagtgtcatttcagctgagcccggacaccgactacattctgagtaactctaacctgaacaaacagtttattccgttttcaggcgaatactggctgcagaactacagcccgtacccgtttttcacagaccgtaaccagctgcagtttgtgtacccggactacagtaaaggtgtgatggttaaatacgttgacgaagaaggcaacgaaattcacgacccgcagaccatttcaggtagcaaaggcgacgtgtacgacgcgtctacagaccagtacaaactggttctggacggttacaccctggacacatcaaaactgccgcagaacagcattggcaactttaaagaagctctgcagaccgtgacatacgtttactcaaaaaacccggttgtggcagccgacgtgaccgttcgctacgttgacattgaaaacaacccgattagcgaagacattattctgcagggtaacattggcgagaactactacaccgacaagaaaaacatcaaagactacacactgaaagaagttcagggtaactcttcaggccagttttcagaaaaagcgcagaccgtgacatacatttacaagaaaaacgaactgccgattgctaccggtaaagttgtggttaaatacattgacacagacggcaaaagcattctgaaagacgtggttcgtaccggtacagtgggcgaagactacattaccgaagagaaaaacattagtggttacacatttcagggtattcgcggcaactctaaaggcaaatacaccgacaaaattcagaccattacatacgtgtacacaaaaaaccacatcatcaaaccgaaagacgaactggttaacagtggtaccaaaatcatcaacaaaacaaacccgaaagtgaaaaacagcagttctgaaaaatctcagaaactgccggaaaccggcgaaaacaaaaaacgtagtatcctgtttttcatttctggtctgaccctgattacactgggcagcacaattattgtttttcgccacaagaaagaacaccaccaccaccaccactaataagaattc

SEQ ID NO: 898 - DNA, 1451 bp, Artificial sequence; identical to SEQ ID NO: 897
  Optimized for E. Coli

SEQ ID NO: 899 - DNA, 320 bp, Artificial sequence
  Optimized for E. Coli
ccatgggtcgctacgacgactaccacgaagcgtgggaaatgaacccgcgtaaactgagcaccgaagaaattgaaaacccgggtaaagttattgaagactttttccgcgtgagccacctgccgggtatgcgtagcagtctgtgggaactgatgaaaacaatggttaccggtacatttagcaacctgaaaagtcgtgaacgcgcacgtctgatttacttttacgaacaggttgaaaaactgattgaagcagcccacgtgctgcacgagaaaaacaaaggcctgtctccgtcacaccaccaccaccaccactaataagaattc

SEQ ID NO: 900 - DNA, 4178 bp, Artificial sequence
  Optimized for E. Coli
ccatgggtccgtacaacaacgcaagcagtggctttggtcgctcttcactggttcagagcattctggacatttacctggccgtggaacagaccgaacgttggaaacaggcggtgaaaacagttggccaggagaaaaaactggacagtaactggatgccggttattcagaacgtgaaaagcattggtggcggtaaatacagtgttcagttcatcaacaaacagaacccggacaacaacccgcagtggattgaaaccaacgacgccacattcgacaacttcaaagttttctttaacgaccaggctaaagacctgggtgcatttttccaggtggactctgttaccggcacagtgtcaacccagattgaaggcggtacagtttctgccggcgtgggtattggctcaaacaaagccgacctggttaaagcggttgtggaatgggtgagcagtggtgaactgtacgacaaatctggtaacccagacctggacacagctgttggtgtgcagagttacctgaacctggcccagtacggtcacggcattgcgacagaagcagccgaagttattagcgctattcgcccggcactgagtaacggcggtgcagttgcccgtgaagtgagcgaaagtctggtgagcaccgttgtgaaaaccacagctacagaaggtctgggcattgcaatgaacattgttaacgttgtgctggacggtattgtgctggctaacacctcttcaagcgttgaacgcgcaagtgtgaccacaaccctggtttttgacgttgtgggcaccgctagttctctgctggcactgggtctgggcattgcgggtgctagcacagcggctagtattctgggcgcaattgctctgccaattgctggtctggcagctggcattccgaccctggttgctctgtacgcacagcgctctgaaaacgcgcgtaaagcggctgaaccgtttggtattattgctgacggctacaaagcgaacgctgacggtacccgtggcatgatttaccaggcagccgaccagtaccagaaaattccgtcagccctgaaaccgaaaggcggtgcggttattaccgaaattgacctggtgaacaaaaaactgaaatttggttctcagtacctgtaccaggttaacccggaccacaaaggtgcaggccacaccaaagtgaacaaccgcgacagctttttcgctggtccagacattggtcgtgcaagcgccaaagcgaaacagctgccgcgcctgagtattcgtcagggtctgggctgtccggaaacaatggacctgaaatacagcgacgttgaagtgattgttctgccgcgcgacattgaaatgacatttgactacgaacacgccattgttgcgccgctgtggcaggaaaacgaatcaagcccgggcattaacgcgctgcgtcagattgaaagtcacccggacatctacgaaaaattctactacgactactgggccaccagcgactacgcgattagtcagttttacccggaatacaaagctacaaccgtgacagttaaactggacaaagcaaaacgttctgttgtgattccgcaggttgccgacattgaacgctcaaacctgacctaccgtctgcagggtaacggcggtacatacattgtggcgctgtctgaacaggaaattgacattcgcattcaggcttcagacaacccggacgaacgttggatttttaacattgacgcaattggcctgcgcacctactctacatggctgcgttacccggactgctggaccgtgacatttcacgacgacggttttaccattggccagacccgcacagaagacaaatcactgcagattacagcggctcagccgcagcgtgttaaatttgaaggtaaaatgccgaactacgttgtgctgagcgacaacattggccacatttttattgtgaacctgaaagaacgcaacatgagtctgatgctgaacattaccaaaattcagcagacagactctaacaaaattggttcaatggacatgaactctgactcactgctgtaccgcgcctacgtttcttaccgttacctgaaacaggcagcccagtctggtaacgctaacgcacaggttgaaaccggcattctgaaatctgtgccgctgacaaacgccgacaacattgcgattgtgtttgaagaaccggactcacgtctgcactacatgggcatttgtgacctgaaaaactttgctctggttgcacactgcaaagaccagacccgtgacaacccgccgcagaccattacacagatgcaggtggaccgttacggtgaactgtctacaatgcgtgaccgcgaccgtccggacaaactggcatttaaaggctcatttgaaaacgtttggaccgccaacaacgaaattttctttacacagaaaatcccgcagcaggaatctggtaccaactcagtgattcagtactgtatgtaccgcggtgaaggcttttgctttattgacgcgattaacgccaacgcgcgtctgatggaccagattctggctgttccgctgagcgaactgcgcaccagtaaagtggaccgtctgctggaccaggcgggtctgattctgcagatgcagccgcgcccggaagtgaaccgtgttgactacgtgtacggcaaagacacctacacaattgttggtcagaacagccagggcgttagttaccagattaaagtgcacaaagacgcggaaccgagcctgagttgggaagaaggtgaaattcagtaccagattctgagcggttacgctctgcagctgaccggcacaagtgctaacaacaccattgcactgacaccgctgagcaaatacccgaacctgaaacgcgcaattctgtttggtcaggaaggcaccgacacatactacgtggaccgtgctattctgcactaccaggcaatttttgttctgaactacgccaaagacaccaaccaggacgtgctgcgcctgcgtggttttcgtacaagcgactttagttacattcagcagggcgaagacattattctgacccacaaacagagtggtaactggctgaacctggtgggcgttagttcttcaaacccgacagcgaaccgctaccagcacctgcagctgcagtttgacgacgttacctttgccgttacagaagtggcgtctcgtctgtcactgggtaccgctgacgtgacaaccatcttcatgaacctggaggacatcacattcgaaaaacaggaagacaacctgattgttagccagaacaacaaaaccgactctacagcatactcaaacttttacacaacctacaccagtctgaacggttttcaggtgaaatttccgtctacaaccacaggcaacatgctgtcactgaacgcccaggaactggcggctctgggtaaatacaacgttaaaggccagaccgttgtgacagccggtagcgcgaaacagtttgtggaccgcatgctggcggaaattggcaacgtgaccatttacgaagttagcagtggtaacgtgagccgtcagggccaggacctggttattaacggtcaagtgtgtaacaaatttttcgaacgcccgacccagagtcgtcagattaaaattccgtacctgctgaacgacggtgcttttattcaggcaggctacgacctggtttttatgcgcgtgaaatacgaccacaactggggtatggacctgtggacctacacaggcgaaacctctccggcatgccgtctgtcttacttttacgactcatacattgaaccgaacccgaaccagggttacgttacaggccgcctggtgcagacctttacagaactgaacaacaacccgtaccgttggggtaccacacaccagctgcaggttgaaaaaggcaacctgaacaacctgctggaacagatgtcagttcagattccgacccaggacggtaaaacagtgattctgagctacgacgctctgaaaaaactgggccaagaaagtgccaaagtgctggcgtcttcaaccagctacgaccagcgcagtaacacctttacatttggttcttactcaaacacagacgcactgattggctttcgtatttctctgtactttgacccgcagaccaacgaagttgtggcagacaaacaggttgacaaatacacacgcaactcatacctgcgtgttccggccgtgattattcaccaccaccaccaccactaataagaattc

SEQ ID NO: 901 - DNA, 911 bp, Artificial sequence
  Optimized for E. Coli
ccatgggtaccgtggctggcgaccgtctgacaaactttccggactctgaatgggttggtcagcgtgaatctatttcatggcagtggcagtcacgcgaaggcctgccgtacctgacctgttctctgctggaccgttggagccacggtttctttacccgtgactttagcccgcgcggcccgattgacctgacagaagtgctggcgccgggtgctaaagtttaccgcctgcagcaggtgcacggcaacgctgttctgaaaaccacagaactgagcccggttgtggcaccggacagcgaaacagcagccccgagttacgcagaagctgacggtctggtggcgggtcgtgaactggaagctctgtgggtttgtagtgcagactgcgttccggtgctgattgctgacgaccgtacaggtctggtggcggctgtgcacgctggttggcgtggtacagcagcaaaaattctgccggaagcgattgctcagctggttgcacagggctctcagctggaaaacctgaaaattgcgatgggtccggcaattgccggcaaagtttaccaggtttcagtggaagttgcggctgaactgggtgcaaccattgccccgaaatctgcagtgtcagcgacagctgacggcatttgcgaatttctgcaccagctgccggaaaccccggttctggctgacccggaaccgggtaaagtgcgttttgacgttcgcctgtgtaacgcactgcagctgcagcagctgggcattgacctgagccaggtggcaattgccccgttttgcacctacagcgacagtgcccgtttctttagctaccgtcgcgaccgcctgaagaaagttcagtggagcggtattgttagtgcgggtggcacaagcagtctgcaccaccaccaccaccactaataagaattc

SEQ ID NO: 902 - DNA, 1424 bp, Artificial sequence
  Optimized for E. Coli
ccatgggtcagccgtggagcccgaccccgcacacagtgaacctgagcggcatgagtgaagaatactacttcatcatctctaaagcccacgacccgtctggtcagccgctggttctgtctgcgaactcagacgctcacaacacccgcgttattgtggccgttcagtcataccaggacgacaaacagctgtgggcgaaacgtctgcgcagcagtggtgacaccaacacatttgcgctggtgaacaaagctcgtggcaccattctggcacgcgaaagcgccaacaacggtgcagccattgtgctggttagtattggcaacattcagacaaacgacctggctgtgtggcagcacgacaacgttgcagaccagtacaacgccctgtgttctgtggaaaactgggaacagaaactgaacattccgggtaacggcccgtaccgcgcaggtacaggcgttattagccactggtgggaccgtggtagtattaacgaactgtttcgtttctttagcgcatcacgcgccctgaaactgaaacgtattgtgtgggacatgcacaacggctcttttgaagaactgaccccggttgtggctctgcagaaaacactgcacaacaactcaaacgcagaacagcagaccacactggaatactctggtgaaaaatcaaaaaccacaaaatacggcgttgaacacggtgtggaagttggcctgagctttaccattagtgcggaagtgccgagcgttgctaaaatgtctctgaccctgtcaacaaaatacaaccacaaagtgacattcaacaaagaagaaaccgaaaaagaaacaatcaaactgagttttccggtgaaagttgcgaaaaacacccagatgacagctaaagttattatgctgcacgcaaaaatggacattccgtttaacgcggtgtttgacatggcttttgaagacggtaccagcgttgaagttgtggaaccgggcgtgtttagcgaagttagttgttacgacattattgctagctacgacgaaagtaccacaaccacaggtggcggtattgcaccggtgggtcaggacaactggcgttggtgtcgcaaatgccagggtctgtttttcgctggtcacgctcacgcttgtccggctggtgacgaccacgacccaaaaggctcttcaaactacgttctgcagagcaccgcaaacacaaaagaaggtcaagacaactggcgttggtgccgcaaatgcggcggtatgtttttcgctggtaacggcgaaccggccggtaaacagtttggctgggcctggtgttctaaatgccagggcctgcactttaccggttcaggcgcaggtgtttgtccagccggcggtggccacctgcacgctggtagcagtgactacggcctgaaatttctgagtcaccaccaccaccaccactaataagaattc

SEQ ID NO: 903 - DNA, 3761 bp, Artificial sequence
  Optimized for E. Coli
ccatggctaaagtttttcacctggacagcgtgagtcacgacaccggtgttgtgattacagacctgggcctgcaggccaacgaacacgacgttgaaaccctggactttcgtgcgggtgacgaaacaccgattgacccgcagcaccgtcagcgtcaggctcagctggaagttgtggacaaactgtacggcccgctgcacattggttcagttacagttacacgttctgctctggacgctctgggtgcaattaccgacggtcagccgctgaacggcgacaacacctttttccgtagtccgcaccgcgtttttgtggacaccctgcagtttaacccggttgacattcaggcctgtattaaccgtaccgtggacgcgaacgactaccgcctgccgacactgctgtttgaaattgcatcacagcgtccgccgacagcacgtccgctgctgcgcgaaattccggacattccggccgaaccgggcgactaccgtggtagtctggaacgcctgctgaacgcagcccagaaactgaacacctctgttctgacacagcgcaccctgagttgggtgaacaaaaccaaatctaacctgctgattccgacaggcctgggtctgcaggcctttggtatttactcaggcctgcgtggtctgcaggacgcgattcgcaacaaagacacataccagaccgcctttaacggtgcgtcagttaccgccgaactggcgagcattggcctggaagcggctattacacgtcaggcaatgcagatgctgaaagctggccagtcagcactgggcagctttgccaaaaccagttttgctctgcgtctgggtcgtgcttctggtctgattgcatcagttctgacactgccgtttgacattattgcagccgtggactctctgaaagcggctgcaaacggtcgtgacgccaccgaccactacgtgaacgccgcgctgtcaatgacaagcgctgcaatgacagttaccattggtgttgctgctctggctggttttacctcagctggtccagttggtctggctgcaggtctgattctggctgtgggtagccagatttggggcgcaattcgcgaagttgacgaaattgacgactacattgaactgaccgtgcacgaacgtctgcgcacaggctggtttgccttttggatgatttcaccggacgacgacattcagcagcgttacaccacagccaaaaccacagcggaacacacccgtcagctgcgcgctacagcactgaaactgctgcagggtaccctgcgcgacagcacagaagctattgttaacggcaaatttaacgttgaactggaagcagtgacatacaacacctggaactggtggaccggtgaacgttaccaggccacccgtgttcgcccgacaattaaagacagcgacgacacaattgacgctcgtgacggtgttacagttgacaccccgggtgctgtgctgggtacctcagcagaacacaaaggtattcactggcacattggtggcggtaacgacacaattagcggcgttgagaaaaaaccgaacgtgtttcactacggcgcgggtgttaaaaaactgaccggcggtgaaaaagacgacgtgtttatttttgaaggttcaccgcagaccctgcgtacaaacccgccgctgccgccgaaccgcctggttggcggtaaaggcaacgacaccattattctgagcggccgtacaaaaggtccgcaggaacagctgggttaccacgtggacctggaagccggccacctgagtattattattcaggaacaggccaaagttcactacccgcacgcggtgctggaatctattgaacacgttgaaattcaggaaggtcgtaccaacgtgattcgcggcacagcgggtagcaacattattaaaagtcgtggcaacgactctattgaagccggcgcgggtgacgaccagatttttctgctgggtgctgacaaccgtgacgcagacggcggtccgggtaacgacgtttacgctattgcacacaaaccgggttctgtgtcaattagcgaagacggcattgacaacagtgttattgccctggactggcgcgcggacctgattgaaggttggaaaattgaaggcgacaacctggttgtgacctctggttttgacgctgacgactggcagctgcgtgaagttattattaagaaagcataccgcccggtggacaacaaacgtcacattcgcaacaacaaactgacatttgttaccaaagacggttaccacctggtgccggacctgccggacaccattgaacagtcactgccgctggacattgaagcggttattacccagcagggcacaccgcgtagcccgattattctgaacaaccagaaaacccaccgcgtggcccacgacaaagacaccagttactacctgtctcgtctgacagcgtcaaccacactgcaggttattcagcgcagcgactttaccacaaccgtgcacctggactacgccagtgcggaactgacccgtattgaagcacactacaacgttcaggtgacccacgacgacgacgactggaacacagttaaatacggcgaatgtggtctgacactgtactttggtgctcaccaggtggcactgaaaaacctggccagcagtgacgaacgttacaccgcgcagaacacacgcaccaaacgtcgcgctttttcagcactgggtagcaaccacctggtgacactgattatgaacgacggcgtttcttaccgcctggtgcagccaaccccggactacggcctgctgctggacgaaacatttattggccagtcttcagttggctggaaaagtgacgtgtctctgccgctgacagctacccgcaaaaaacacatgcacctggcaccgtcagacaaaagcccgtactacatgcgcaaccgtgcaacctgtgctcagctgacaagtccgtctgaacagaccggtattgaagttctgattggcgaaggtgcaacatacctggtgcacctgagtccggacatgaccctgcgtctgtctacaccgggtgctctggcaggtgcaaaaccacgtctgccaaacgctagtacctgggaactggacgcaacccacctgggtacagttgaaattaacctgtctgctaacctgctgcagattggcacaaccattattcacctgccgacctacgaagcagaagacctggttgacaaaattcgtgtgattaccgcccagggtattgtttacgcggtggacacactgtttgaacgtgtttacgtggaagctctggacgcacgctactttacctttccactggacccaagtgctgcttggccaagtgaactgtctgcgctggctacacgtgacctgcaggtgctgaacattgctctgaaagacggcgcacgtggcggtctgcgctactcactggaaacccgcaaatggacactggaaaccgacaaaacacgtctgattgaaagccaggacctgcgcaaaacaaacctgtgtgaccaccacctgaacttttaccgtgacctggcttcagaaggcctgggtcagaacccgccgacagacgacggtgcactgcgtgttctgcgcgaaaaatgcgtggcactggccgaaagtctgacactgggcaacagtaaatttctgtctcagacactgaccctgtctctggcctttggtatgacagcgccgcagctgtcacgtctgctgagcctgtacggcagtctgccgaccctgtttacaagcccgccgattcacatgcaccaccaccaccaccactaataagaattc

SEQ ID NO: 904 - DNA, 1367 bp, Artificial sequence
  Optimized for E. Coli
ccatgggctcttttgaactggtgattggtaaagttggtggcggtaaatcactgtacgcgatgcaccgtctgattgaagaactgctggaagaaggcccggaagcacgcctggttgtgaccaacctggccgtgaaagaaccggaactgaacgaatacattcagcagaaacacccgatggctaacgtgccgctgagcaaacgtctgcacgttattgaagacgaacagattgaacgcttttacgaaattcgtcgcctgaaagacggtacaccgtgggaaggcggtatcttttacctgctggacgaactgcacgcaaaatttaacgcccgtaactggattaaaattgaaaccgccgtgacacactacctgagccagcaccgcaaactgggcgacgacgtgtggggtaccacacacctgccggaacacgttgaccgtcagatgcgcaacctgagttacgcgtttcacatgctgcgtaacgactaccgcaccgtttttcgtatgccgattctgggtattgctgtgaaaccgcgttcttgttttgttcgcaaatcatactactttgacccgaccaaacagcgtaacccgcagccgtacgaagtggcgacatttcagctggacgcgcagggcattgctaacacctacgacacagctaaaggcgttggtattaaaggtaagaaagcagacaccgctcgtatgcagaagaaaggtctgccgctgctgccgacaatgattgcagccggtattgcaatttgggccgtgtttcaggttccgaaactgtggatggaacgcgcgtacaaagctcaccaggaaaaactggctgctgcagcaccaagctctcaccacggcaccacaccggctccaaccctgtttgaccagattgctccgtcttcactggaatctgtgacagttattccggcaaaaccggtggacgacaccccgtggccgacaatgaaacagattgcaacctggccggcccagaaagttagcgccgaacgcaaaacataccgtggcattgtgcgcagtggtcgtcgcctgcgtgtttacctggacgacggtcgctacctgaccgaagcagacattctgacagtgggcaaaggtgttgtggttacccgtgacggcgccgtgctgtttgaacgcgttctgaaaccgggtgacattgttcagacaccgcgtgaaggctttcagggtccggcaccggttagcgttccgccgccgagcccagcaagtccgctgcagggcaccccggcggctctggcagccccggtggttattgaaggtccgggtgttcgcccggacccagctaaaccatttgctggttcaggtctggacaaaccgtttggtcaccaccaccaccaccactaataagaattc

SEQ ID NO: 905 - DNA, 461 bp, Artificial sequence
  Optimized for E. Coli
ccatggacagcaccgtcagtgtaaaaggagttgtgactagcattccttgtacgatcactcagaaaaacaacggaattgttgactttggggacgtgctgaccacacgtatcgacggtagcagttacaaaagctaccagctggtcctggacctgcaatgcgacaccccggttaacgcggacacaatgctgaacctgtctctgtcaggtaccgaagcgcctttcggagaggggctgctggctacagacaaagaaggtctgggcattcagtttcgctggggcgaccaaaaatacccagttaactccgccgtgtccttctcgtacctgaaccacgaccactctgtctacatgtcagtaacgccggcaaaagacgacagtgttgaactggagggtggcgcctttaccgcaacagccacgctgactgtggactaccaacaccaccaccaccaccactaataagaattc

SEQ ID NO: 906 - DNA, 461 bp, Artificial sequence; identical to SEQ ID NO: 905
  Optimized for E. Coli

SEQ ID NO: 907 - DNA, 5081 bp, Artificial sequence
  Optimized for E. Coli
ccatgggcattagcagtatcgaatcgaaaacagagaaaacgagcctggttgagaaaaaacagttctctatcgaacctaacaaagaagaggacaaaatcaacaacaagaaaattgcgatcaaagacgaatctaacgagcagccaattgagaaaaacaaacgtacatcagctcgcaacaacaacccgtcagacaacttcgactccgtgcaggggaacaacggtaactactttaaaccaaccacagacgccacgctgctgaaaattggtgaagagcaggcagcccgtgttcaatcggacctgagcaaaaaatctattaacatctcaaacctgcagcacgagaaagacgactcatttgaagttctgaacttctccacttgtatttttccaaacgacaaaggtctggtgatgtggccgatcaacggtggccgcaactctgtttactggacccaggtggactcaaactccggcatttggcgtatgcgcctgtacgcggctatggactcaaaaaacgaaccgtacctgaacgcgaaatttacccgtctgaaatacggttcggtcagcggcaacgaagtatttgcgttcccgcgcgtggcttacctgagcaaccctacaggccacattaacgacatgaaaccgttcctgactaaagccacctttgaagtccgtctgcctacggcggaagaggaaattggcaaaatcgtagcgactgctaaagaaggaacccacaaactgatgcagaacgctcaaccgattcctaacccagaaacatacctggacgtaaaaaacacgcgtggtaaagttgaatacagctggaaaattgcaccggacacgactaaagttggcaaacaggacactaaaatcctggtgaaagacgaaagtggacgcgagatcgaagttgtggtcccaattaccgttgagccgctggctgtggaaattaaaggcaaaccgggaccttttgacatctaccagtacgacaaactgcctgacgtcactgaatacttcgaggtaaccaacctgtacggtacatacacgctgaaatggtttgacgacgtcaacactgactctccaggggaacagacctggcgtgctaaagtaaccacatcagacggtcgcgaagcaacatcttcaatccaaatggacgtcacgccacacgagggcctgaaagtaaacctgaaatctattgaagaccgtaaactgggatacaactacccgacatttgccacgaacttccgcgactacattgactctgtgacaatgcacggtgaaccggtcgagctgcgtgacctggaatttattcctcaggaatcagcagaggccgactaccgcatcggagggctgcagaccctgaaactgactgtccaaaccaaacaccctaactcaggcgtaatgattaaaggaactggggaagtcaccctgaacgtactgtgggaccactcgatcctgatgaaaagcattaacggagaatctgccgggtcattcacactgcgtacggacaacagtggtaacgaaaccgcgaaagtagtttttggtatgggcatcccgacatctattaacacggctgttggtccacagtccacaccgttctcgctgtactacagctttgaggttctgcgtggcgaaacggtgatttactcacaagaagtcactaaccgcgcaacctggcagcaaattatggacaaatttggtgactccactggcaccatcgacgtccactacggtgacgtaattaaaatctaccaccctgaacgcaccccaaactcctcggtgctgatgatcgacgagcaggaacaagactacacttacgacacgacttacgcctactacaaaattaccccgtacggctttgacccattcccgctgctggaggcggaagcttcccagaaatcgttcgttctgggtgaaaacacaaaaacgattgaccctgcgagcctgatcaaaaacgtaacaattaacggccgtctggttgacagcagttcttacgaggtggaaagtctgatcgactttgacacatcatccattggcacgcgcaaaatgaaactgaaagttaccatgaacgacggactgtccgcggaggaatttgaagttgactaccaggtgaaatggggatcgacatttgttctgaaagggctgaacgacgcaacggtgggtgccttcagcctgctgaaagaaaacgaccagtgggcactgcacgcctcccaaggggtcaacggtaccgacctgtcgcagccggtaaacaaccactttggacgtgacatttactacgggattgaagttatcgagaacattaccacaaaataccagtacaacgtgctgggtaaccaaagtatcaaagaaggcattgagggatttaaccaggggaaacctctgactgtgaaacaaggtgacgttatcaaagtgtaccacgcagagccaaccggcaactccctgctgatgcaggacgaaattgccaaagacttcacaatgggcagcaacgacgcgtactacgaagttacggagcacggactggaaccaatcctggcaattagcactgacaccaaaccgcaggaatttagtctgggtgacgacgcctctgggattgacggtacacagctgatcaaccaagttacgattaacggcactgaactgaccccggacctgtacaccgttaaacagctgggcaacttcgacacgactaccgtgggacagaaagaactggctattcaatttgacactaaagacggtgttgtcagtaaagtcattaccgtaccttacaaagtcaaatgggggcgcactatcgtaatgaaatcgagcaccggtggcagtgcaggtgtgttctctctgcagacaacgaacactacccgtcagctgaaaatccaccaagggtttgacagcccgctggacgaacgcctgggtaacgaccaggacctgtactactccattgaggtactgcgtggcgaaaaagttcagtactcgcaagaggtcccgggacgcgtaactctgcaggaagtgattaacagttttggcacaaacggaacgcctgccgtaaccgttcagctggacgacgttattaaaatctaccacccgcagaaaagccctggcagttctgttctgatggtggacgaactggaggaagactttacatacgggagtgactacgcttactacaaagttacaacgtacggtttcgaggcaatgcctgtcatggaagtacacacggcgaacaaagctttttacctggcccaggacgttactaccgtggcagacgccgaactgatcgaccgtgttactattaacggtaaaaccgtggacccagaggaatacacaattgaacgtcgcagcgagatcgacacaaaaacgattgggaacaaaaacgttgcgatgcgcgtgaaaatgaacgacggtctgtcatccgttcagctggaactgccgtaccaagtgaaatggggcagtaccttcattctgaaaggagaggaaaaagaagggaaacgtggtatcgttggcagtttttctctgctggaccagaacgaccaactggcaatttacgccacaaaaggcgaggacgaaacggagctgaacgcacctgtgaacccagcctacggacgtaacgcgtactaccgcattgacatcctggccgaccctaaaaacaaagcgaactctctgtttccagacaacattaaatacacttacgaagtggctggtaaccagaccgtccgtcaagcaatcgaaggattcaacaacgggcagtcactgccagtcgaggaaggcgacatttttcgcgtataccacgcagaaacagacaaccaaaacctgctgatgtgggacgacattgttaaaaactacacggctgggctgaactacgcatactacgaagtgaacaacggtgaatttgagccgatcacactgatttacgcggacgtagctagccaggaactggttctgggtgaagacacgagtgaggtggacgtcacaacgctgattgacaacgtcgcattcaacggccagagcctgaacagtgagctgtacaaagttgaacaaacaggggcctttgacacgcacactaccggtgaaaaaactgtaaccgttaaagtgtccacagcggacggcgtttcgagcacggacattgaagtcccgtacgaggtaaaatggggctcaacaatccacctgaaaaaccgtaaaggagaaacggttggatcgtttgggctgctgaaaaacagcaaacagattgaaatccagagtgttcaaggtactgaccaaaccgttctgaaaaaccgcgtgaacgagtacgacgacaccgaagtttactacggcattgaaatcctgaacgagcgtaaacagtctaaataccaatacgaggtgcgcggtacacagacgatcgaacaagccatttctcgttttaacactggcaaatcactggcggtcaccccgggagacattgtcaaagtataccacgtagacacatcaaacaacctgctgatggctgaggaaagcgaacgcaactacacttacggcagtaactacgcatactacaaagttaccgactacggtttcgaaccaacgggtgaactgaccgtggaaccagcacagcctagctttgcgcaaggaaccgagcgtgtggacctgaaaagtctggtcaaagaagttaaagtgaacggtcgcgttattccgaaaaacgtctacactgtatcactggacgggaccagcgagatcgacactgaaacaatgggtagtcgttttgtttctctggacgtcaaagtagaccgttcttacggttcactgtccacacgcacggagagttcttacgaaatcgttgagcctggtcaggaaactgctccaggcgaggaagacgcgtctgctgaggacggaactgggacctcaaacgacccggacgctgacgggatttcagcagagaccggtctgggcgaaggatccgcagccgaaggagacgagtcgaaactgcctcagacaaaccaaacgatcaaccgtgttctgccatacattggggcatgcttcctgctgatcgttggttttgtgttctggaaacgcaaaatgtctaaaaaatcattcgacaaacagcaccaccaccaccaccactaataagaattc

SEQ ID NO: 908 - DNA, 5081 bp, Artificial sequence; identical to SEQ ID NO: 907
  Optimized for E. Coli

SEQ ID NO: 909 - DNA, 2543 bp, Artificial sequence
  Optimized for E. Coli
ccatgggccctacggtgccaacttacaactcacgtcagacagtcgaccaaggactgccagcaccgcaggtctccgtacaaaccaacccggacacatttggtgccggcctgggagaagttggcaaccgcattgccggaatcttcgcgcaggagcaacacaaagccaacgtggcgcagacccaagacgcagtcctgcagtttcaaagtttcgccgacgaccagtttaacaacacggactctggcctgtacactaaacaggggaaaaacgcggtgggtcaaagtgaagctgtcctgaacaacattcgtggtaaagctgacgaactggcacagcaagttcctgagtctatgcgtcgcgactttatgcagcaaattaaccaggcgggccagcaatacaaacgtcaagcttcaacatacgaaatcgggcaagtacgccaatacgaagagggtcaatttaaagcactgcaagagtccacggttactgcagcccagggtcaatacaacgacccacaggcgttcacctctacagtgaaacaggggtttacggctattgaccaattcgctgacgcacacggttggtctgacgaagagcgtgccaacgcgaaaaaccagctgaaagaacgttcagctgacggtgcactgtctgctgctgcaaaccagaactacatggactttattgccgcgaacggagaacctggggactacgacggggcaatgcgtgtttcaggttctacaggtgacgcacgtggcctgcgtaacaacaacccaggcaacatcgaagccggacagaacaactgggagggacaagcggggagtgacggtcgttttgctaaattcgttacaccggaacacgggattcgcgcactgggtaaaaacctgctggcctacggcgacaaaggatacgacacggtgaacgagatcgtcaaccgctgggctccggcatcagacggtaacaacaccacagcctacgtaaaagcgctgtgtgaacagctgagcgttaaacctgacgaccagctgaacctgtcagacctgaacgtgctgaaaaaactgtccgcggggattgtcaaacacgagaacggtagtatcccatactctgacggacagctggacaccggtctgcgtgctgcactgggcctgactagtctggaatctccgaaacgctacaccggaaacgtggcatttgacgctgcttctacacaggcacaagctagctacctgcgtcaggccaaaagcctgcaaaacgaggcacgcacccagctgaaagcccaactgacagacgtgattagtgacgctaaagcatcttacctgaaaggtgtcgaatacccgaacccgcctagtcaggcgcaactgatctctgcttacgggtaccgtgaaggtaaccagcgctttgcagacctggagaaccagcgtgtggccggccaatacattggaagcttccgcaacatgcctagcagttctatcacgacttacgtcgcggacctgaaaacgcagctggggactggtgaaggctttgctggccgtgccgacgcgttcgaccacgtagaagctgcagccaaacaggttattaacctgcgcgagagtaacccataccaggcggctatggacatgggtgtttacaaacctattgcatcgaccaacccagccgacattacaagcgaaatcaaaaaccgtaccgcagccatcgaccagctgaaatcgctgggcattaacgcaccgatcctgagcaaagaagaggcggcttcgattagcgaacgtgtacgcggtaccacagacgttaaccagagtatctctctgctgcaatcttttggtcgtgggctgcagccacaagctctgcgctcagttgcagcctccattgctccggactcagcggctacagcctactccgcgctgatcctgggtacggacgacaaccagtacaacaaccgttcaccgtccattccttactcacagtttgtagcatacaaaccgactatgaacaaatacgaagttgccaaaaccattctgcagggagaccaactgatcaaccctactaaagctcagaaagacgcaggtattagcgccgttaaactgccagcggacgacaaactgaaacagacctttgacgacgaaattggcaacgctttcagtcacaaccctcaggcgcgccaaatggcttggtcgatctacaaaagcgcttacgcaggtctggcgtacacatcaggggactccgacggtgtaaacacgaaatcggttgacagcgacattgctgaaaaagcaatccagatggcaaccggtggcgtgattaaaggctttaacggaggggacgttgtgatgccgtttggaatggacaaatcgacgttcaaagaccgttacactgcagccgcgggcgacgcactgaaatcagccggactgaacccggcctcgcagagcaacttcgttcctgtgaacgtcggcgacagtcagtaccgtctggttactggttctggccgctgggcgaccgacccaaaaacaggtgctccgattaccgtacgcgttcagcaccaccaccaccaccactaataagaattc

SEQ ID NO: 910 - DNA, 1538 bp, Artificial sequence
  Optimized for E. Coli
ccatggcgattgactacaacctgtttaactacaactaccctgtgagcgcctactaccctaaaagcagtgacaaagcgaacgtcatgggtcgtattatcaaaattaacaacgtccgcaacgactacagcgtaagtattccgatcgacgtttctcagaactcagaaggtaaactgaactactttggcctgaccacaagcactaacgcttacttcacccacgactccggcaactcgattaccaacgcaggaagtctgacgggtccgaacacgctggtaggtccaggactgcagaaccctgttaaactgcctattccatcttcaacgattactatcgacggccaaacctactactttaactactacgttgtgcaggtcgtaacagagaaagtaattagtcctatcaacgaagttcagggtaacaactacgcactgcagccactggacaccctgccagctaacgcaaacttcgcctgggcgtactactctgactcaccgggagcgattatccactacaaaactgaagacgggaccgagctgctgactagcccaaccctgatttccgagtcgggagacacaatcccgagtgaagttcgtgactttacaggttacacgctggttagcgtgccagaagaggacagtttcaagaaagcacagctgactaacctgacctacgtgtaccgcaaaaacccggtcgcagccgcgaccgtcacagtaaaatacattgacacacagggtaactacattagcgacagtatcccgctgtctggcaacgttgaccaggaatacacgactgagcaaaaaattatctcaggctacacctttaaagaagtgcagggtaacaaaagcggcctgttcagtaccacacctcagacggttacttacatctacgctaaaaacccaatcgaaatcaaagcaggatctgtcactatcaaatacgtagacaccaacgggaactctatttcagacgtgatcacgaaatcaggaaacgtcgggtcctcgtttgactccgagcaaaaagtaattctgggttacacctttaaagaagttcagggaaacaaatctgggctgttctcaacgactccgcaaaccgttacatacatctacaccaaaaaccctatcgaaatcaaaacgggtactgttaccatcaaatacgtggacactaacggcaactccatttcggacgagatcaccaaatctggtaacgtgggctccctgtacacatcggaacagaagaaaattctgggttacaacttcaaagaaatccagggtatcgcagagggccaattcacgatcgaatcacagacagttacgtacgtgtacactaaaatttctccgcctacaattatcaaaacgtcagtgatcccaccgaaaacactgtccgtcaaaacgctgcctaaagaatcgctgccagagacaggaaacaaatttttcgggtttacgctgctgagcggtagtctgctgattttagtgagtaccacactgtacctgctgaaatctcgtaaatacaaacaccaccaccaccaccactaataagaattc

SEQ ID NO: 911 - DNA, 1538 bp, Artificial sequence; identical to SEQ ID NO: 910
  Optimized for E. Coli

SEQ ID NO: 912 - DNA, 1577 bp, Artificial sequence
  Optimized for E. Coli
ccatgggtaacatcaaaacattcaaattcatcgacaaatactctaacggcattgttgtgaactttgacaaccgtaacaagaaaaccgttaccatttctctgtttctggacaacgaaaacatcaaaacaatctcaaccaacaacgaccactacctgtttaaagttgacaaatctggtaactaccacgtgaccatctctttcatcgactcaaacaaaaacatccaccacctgattgacagcccggccagttactactttgcgcagcagaaaacaaaacagaacattaagaaagaatctaaatcaaaaaccattaaccacaaaattgacggcatcaacaaatactttctggaaatcaaaagcgaaattaaaagcagtcacctgattatggacattctgccgaacgaactgatgaactctaaactgatcctgatcaaatcaaacatcgaatcttcagtgaaacagtacgaatacctgaacctgtacggtgaagacaactttgaccgtctgctggaactgtctcagaaaattgaacagctggactacgtttcatactgttgcatttgtccggacaccacaggctacctgccgccgaaactgccgctgaacagtcaggtgctggaagaagacacaagcagtaacgaaattacaccgaactttacctacctgcagaaatacctggacgctccgatgggtatgaacgttcgtaacgcatgggagaaaaacattgacggtagccaggcagttgtgcgccacctggactttggcgtgtacaaaaaccacgaagacctgaaaaacagcaacctgattgttgtgaacagtcgcccggaaacccaggactgtaaccacggtacagccagtaccggctgcattattgctacaaaaaacgcatttggtgttaccggcattgcgcacaactgccagttttacttttacgacacagacgacctggaccagctgaccaacgacgctcagccgggtgacattgttagcctggacattcagtttagttttggcgaaaaactgctgccggcgacagctgtgcgtaactggtgggaacgcattaaaattatggttgacaaaggtgcaaccgtgattctggcagctggtaacggtggcctggacctgagcgaaccgggtgttatgacagactttggtgacaacggcagtatgctggttggtgcctgtaacaaccagaccggcagccgtgcgtactttagtaactacaaccagaaatcttcactgattaactcttggggcgactggtctgtgaccacaaccggttacggctctctgcagaaatacccgggtaacgaacgcaactacaccaaagactactcaggcacaagcagtgctaccccgctgtgtgcaggtgcactggctctgctgcagggctacgctaaacagcaccagattattctgagcgcatggggtatgcgtgaactgattaaaaaatctacatacaccgaaggcgttaacgacggtattggctaccgcccgaacgtgaacgacctgctgaaagaaattgacaaactggcgcagattaccgaacaccaccaccaccaccactaataagaattc

SEQ ID NO: 913 - DNA, 1634 bp, Artificial sequence
  Optimized for E. Coli
ccatgggtcaggactctcagcaccgtatggccaacgaccagaactcagttatttacgtgtgttttagcaaaggcattaacagtgaaaaagcagcctttagccgcaacgcggacctggaacgtttttctcgcgaaaaccacatttcatttaaatacgacctggactttaccgacaacaaactggacgaaatggcccgtaacagcaaagcgattggtaactctacagaatcagttgaaaaactgaaacgcatttacaaagctgacctgccgctgcagagtaccgaaacagcagaaaaaattattcgtaccctggaacgctttccggaaattgaatacgttagcgtgatgagtgcggaaccggtggaaccgccgctggttaacgcctttgtggcgaccccggacctggaaagcctgcagacatacctgaacgacaacccgggtattaacgctaaatacgcatggagtcgcggtattaccggccagaacattcgtgttcgcgacgtggaatacggcttttacaaaacacacgaaatgctgagcaaccagaacagtattcagctggaaccgggttactctccgaactcaggcctggccaacaacaactaccgtgaccacggtaccgcggttgtgtctattctgggctcaattaaagacaacattggtctgaccggcgcggcttacagcacaagtgaaattaaaggttacatggaatggaccacagttggctacaaccgtgctagcgcagtgtctcgctcaattaacgccagtcaggcgggtgacattattctgtacgaaatgcagaccggtggcaaagacggccagtactgcccggcagaatacgaccaggttatttgggacctgaccaaagcagccacagactctggtattattattattgcggctgctggtaacggcaaccagaacctggacgacccgttttacgctaactacctggcacgcggtaactcaggcgctattattgttggtgcaggcagcccgaacaccacacacagtaaactgagctttagtacctacggtaaccgtgttgacgtgcagggttggggcagcagtgtgctggctgctggttacggctcttacgctaaatacgacaacgacaacaaccgcacatacaactacttttcaggcacctcttcagcaacaccggttgtgagcagtgctgcaattctgattcagtctttttaccgtcagaccacaggccagtacctgaccccggccgcgatgaaaaacctgctgatttcaacaggcattccgcagggtggcaccgttaccggtcagaaaattggcccgctgccgaacgtgaaaaacgctattctgcagctggaaagcaaatttgccaccccggttaaaacactgagtgcgctggaagtgaaaatttacccgaacccgtcttcaagcagtattgccattcagagtaacgaaaacaaaaaactggacatcgaaatcatcaacctgcagggccgtaccgttattaaatcttcagtgctgtctcacgaaaaaattgacatttcacagctgccggccggccagtacattattaacattaacgaaggccagcgtcgcgttgtggaaaaactgacaaaaattcaccaccaccaccaccactaataagaattc

SEQ ID NO: 914 - DNA, 1634 bp, Artificial sequence; identical to SEQ ID NO: 913
  Optimized for E. Coli

SEQ ID NO: 915 - DNA, 1631 bp, Artificial sequence
  Optimized for E. Coli
ccatgggtcagaaaccgagtaacggcgactcttacgcaaaagccaacatctacgtttgtttcagtaaaggtatcgcgtctgctaaagcagcctttgcacagaacccggaactggaaaaactggcccgcgaaaacagcatgagttttacctacgacctgggttttacagacgaaaaactgtcagaaatggcacgtaacagcaaactgaacggctactctccggaatcagtggaaaaactgaaacgcatttttaaagcggacctgccgctgcagaacgaagaatacgctcagcgtctggcacaggccctggaacgctttccggaagttgaatacgccagcgtgatgagcagtaccccggttgaaccgccgctgattaacgcatttgtggccaccccggacctggaaaacctgcagacatacctgaacgacaacccgggtattaacgcgaaatacgcttggtcacgcggtattaccggccagaacattcgtattcgcgacgttgaatacggcttttacaaaacacacgaaatgctggcgaaccagaacagcattcagctggaaccgggttacagcccgaacagtggcctgtctaacaacaactaccgtgaccacggtaccgctgttgtgtcaattctgggcagcgttaaagacaacattggtctgacaggcgcggtgtacaacgctagtgaaattaaaggttacatggaatggaccacagttggctacaaccgtgcggctgcagtgtctcgctcaattaacgcatctcaggccggtgacattattctgtacgaaatgcagaccggtggcaaagacggccagtactgcccggcagaatacgacaaagtgatttgggacctgaccaaagccgcgacagacagtggtattattattattgctgcagccggtaacggcaaccagaacctggacgacccgttttacgcctcatacatgagccgtggtaactctggcgcaattattgttggtgccggcagtccgaacaccacacactctaaactgagctttagtacctacggcaaccgtgttgacgtgcagggttggggctcttcagtgctggcggctggttacggcagttacgcgaaatacgacaacgacaacaaccgcacctacaactacttttctggtacaagcagtgcgaccccgacagttgcttcagcagccgtgctgattcagagctactaccgtcagaccacaggccagtacctgtcaccggcggctatgaaaaacctgctgattagcaccggtattccgcagggtggcacagttgcaaaccagaaaattggcccgctgccgaacgtgaaaaacgccattctgcagctggaaggtaaaagtgcgaccgctgttaaagcgctgccgtctctggaagtgaaaatttacccgaacccgtcacagaacgttattacactgcagaacgtggaaaacaaaaaactggacttcgaaatcatcaacatgcagggtcgtagcgttattcgcggcaccgctatgccggaagaaaaaattgacctgtcttcactgctgccgggccagtacattattacaattagcgaaggccagcgtcgcgttgtggaaaaactgattaaacagcaccaccaccaccaccactaataagaattc

SEQ ID NO: 916 - DNA, 1631 bp, Artificial sequence; identical to SEQ ID NO: 915
  Optimized for E. Coli

SEQ ID NO: 917 - DNA, 1631 bp, Artificial sequence
  Optimized for E. Coli
ccatgggtcaggaatctcagccgaaactgaaccaggaccagaactcaatcatctacgtttgtttctctaaaggcatcaactcagaaaaaaccgcttttagtcgcaacgcagacctggaacgtttcagccgcgaaaacaaaatcagtttcaaatacgacctggacttcacagacggtaaactggacgaaatggcccgtaacagcaaagcgattggcaacagcagtgaaagtgttgaaaaactgaaacgcatttacaaagccgacctgccgctgcagaacgaagaaaccacacagaaaattattcacagcctggaacgttttccggaaattgaatacgttagtgtgatgaacgcgaccccgattgaaccgccgctgattaacgcctttgtggcgaccccggacctggaaagcattcagacatacctgaacgacaacccgggtattaacgctaaatacgcatggagtcgcggtattacaggccagaacattcgtgttcgcgacgtggaatacggcttttacaaaacccacgaaatgctgacaaaccagaacagcattcagctggaaccaggttacagtccaaacgctggtctggctaacaacaactaccgtgaccacggtaccgccgttgtgagcattctgggcagtattaaagacaacattggtctgaccggcgcagcctacaacacatctgaaattaaaggttacatggaatggaccacagttggctacaaccgtgcttctgcagtgtctcgctcaattaacgcttcacaggcaggtgacattattctgtacgaaatgcagaccggtggcaaagacggccagtactgcccggcagaatacgacaaagtgatttgggacctgaccaaagcggctacagacagcggtattattattattgcagccgcgggtaacggcaaccagaacctggacgacccgttttacgccacctacctggcgcgcggtaacagtggcgctattattgttggtgcaggctctccgaacaccacacactcaaaactgagctttagtacatacggtaaccgtgttgacgtgcagggttggggctcttcagtgctggctgcaggttacggctcttacgctaaatacgacaacgacaacaaccgcacctacaactacttttcaggcaccagcagtgcaacaccggttgtgtcttcagccgcgattctgattcagagcttttaccgtcagaccaccggtcagaacctgaccccgtctgctatgaaaaacctgctgatttcaacaggcattccgcagggtggcaccgttaccggtcagaaaattggcccgctgccgaacgtgaaaaacgccattctgcagctggaaagcaaatttgcgaccccggttaaaacaagtccgctggaagtgaaaatttacccgaacccgagcagttcttcaattgcaattcagtctaccgaaaacaaaaaactggacttcgaaatcatcaacctgcagggtcgtacagttattaaaagcagtgtgctgtcagacgaaaaaattgacatttctcagctgtcaaccggccagtacattattaacattaacgaaggccagcgtcgcgttgtggaaaaatttacaaaactgcaccaccaccaccaccactaataagaattc

SEQ ID NO: 918 - DNA, 1631 bp, Artificial sequence; identical to SEQ ID NO: 917
  Optimized for E. Coli

SEQ ID NO: 919 - DNA, 1634 bp, Artificial sequence
  Optimized for E. Coli
ccatgggtcaggacagccagccgaaaatggcaaacgaccagaacagtatcatctacgtttgtttctctaaaggcatcaactcagaaaaaacagccttttctcgcaacgcggacctggaacgttttagccgcgaaaaccacattagttttaaatacgacctggactttaccgacaacaaactggacgaaatggctcgtagcagtaaagcaattggtaactctggcgaatcagttgaaaaactgaaacgcatttacaaagccgacattccgctgcagaacaaagaagcgtcagaaaaaatcatccacatcctggaacgttttccggaaattgaatacgttagcgtgatgagtgctgaaccgattgaaccgccgctggtgaacgcatttgttgtgaccccggacctggaatctctgcagacatacctgaacgacaacccgggtattaacgccaaatacgcgtggtcacgcggtattaccggccagaacattcgtgttcgcgacgtggaatacggcttttacaaaacacacgaaatgctgtctaaccagaactcaattcagctggaaccgggttacagcccgaacgctggcctggcaaacaacaactaccgtgaccacggtacagctgttgtgagcattctgggcagtattaaagacaacaccggtctgacaggcgcagcctacagcgcaagtgaaattaaaggttacatggaatggaccacagttggctacaaccgtgcttctgcagtgtctcgctcaattaacgcctcacaggcgggtgacattattctgtacgaaatgcagaccggtggcaaagacggccagtactgcccggctgaatacgacaaagttatttgggacctgaccaaagcggctacagacagcggtattattattattgcagccgcgggtaacggcaaccagaacctggacgacccgttttacgctacatacctggcacgcggtaacagtggcgccattattgttggtgcgggctctccgaacaccacacactcaaaactgagctttagtacctttggtaaccgtgttgacgtgcagggttggggctcttcagtgatggctgcaggttacggcagctacgccaaatacgacaacgacaacaaccgcacctacaactactttagtggcaccagcagtgcgacaccggttgtgtcttcagccgcgattctgattcagagcttttaccgtcagaccacaggccagtacctgaccccgagcgccatgaaaaacctgctgattagtacaggcattccgcagggtggcaccgttaccggtcagaaaattggcccgctgccgaacgtgaaaaacgcgattctgcagctggaatctaaatttgctaccccggttaaaacactgtcagcactggaagtgaaaatttacccgaacccgagcagttcttcaattgccattcagagcagtgaaaacaaaaaactggacgtggaaatcatcaacctgcagggtcgtaccgttattaaatcttcagtgctgccgaacgaaaaaattgacattagtcacctgccgacaggccagtacatgattaacattaacgaaggccagcgtcgcgttgtggaaaaactgaccaaactgcaccaccaccaccaccactaataagaattc

SEQ ID NO: 920 - DNA, 1634 bp, Artificial sequence; identical to SEQ ID NO: 919
  Optimized for E. Coli

SEQ ID NO: 921 - DNA, 2105 bp, Artificial sequence
  Optimized for E. Coli
ccatgggtcagattctgtcgaccgacaacctgccgacactgggactggggtctgacgcttttcaattcgacccgctgcctagcagtgacggtaccgaacgttttctggcaaaatacggccagaacgcagccaacctgacgagtgaagagaacaaaactaaaaacctgtctgaaatggctcaggactacgcacgtcaaaaagcggctgacgtggccacggacgagattagtcactggctgtctaaagcgggtaacgctcgcctgaacattaacctggacaaacagctgagtatcaaaaacactcaactggactggctgattccgtggtacgaccagccggacctgctgctgttttcgcaacacagcattcaccgtaccgacggtcgcctgcagacaaaccacggtatcggcctgcgtcactttaaccaaaactctatgatgggtctgaacacatttttcgaccacgacctgtcataccaccactcccgcctgggatttgggctggaatacgcccaggactacgcgaaaattagtgctaactcttacctgcgtctgtcttcatggcgctccacctcggaactgaaagacgactacgacgcacgcccagccaacggatgggacattcaggtagaagggtggctgccgacatacagtaacctgggtgcgaacctgaaactggagcagtactacggtgacgacgttgctctgtttggcaaaaacaaacgtcagaaaaacccgatggcaaccacagtcggtgtacactggaccccattcccgctgctgggcattaacgccgaacacaaaatcggtaacggcaacaccaacgagacacgcgttaacctgggtctgacgtggctgctgggcaaaaacctggcgcagcacctggacgtctcagcggtagacgctactcaccgtatttcctcgaaccgccacgactttgttaaccgtaacaacaacattatcctggaataccagaacaaaaacctgattctgctgagcctgcctcaggtcatccaaggagtaaccggggaagaggtgtcaattatccgcaacctgatttccgaataccctctggagaaaattatcgtcgaagccccagagctggtagcagccggtggctcaattacactgaacggtctgaaaagcagtgttaaactgccttcctacaaaatcgaagagaacgacgtgaaaaaccagcaactgaaccgttaccgcctgaccgtcacagcatacgacattaaaggcaacatgtcaccacaggccgaaaccctggttgaggtgtccaacacaggactgctggccattatccacaaaaacgggacgaaaaaatcaaacgtcattgcgaacggtcgtgacccgaacgtatttaccgttgtgatcaaagacgcactgggccacacagttccgaacgccaaagtgaactttacgctgcctgtgggactgactagcttcaaccagaaaaacacctcatactactccctgtttaaccacttcatgtggaaagcacaggtcgccaaaagcgcgagtgaacaagagtttgctattatcgcaaacagtaaaggcgaagcatctattcagttcacggcctctgtttcaggttcctacgccctgaaagcgagtactcagtacggcgcggaaatcaacgagcaatttaacttcaaaccggacattgaccagtcgtttatcggaagcattgaaatcatgcaaaacaacgcgctggctgacgggaactctaaaaacaaaatcaaattccacatcgttaacaactcgcgtcagagcattgcaggagcccaagtttacttctcggggaaaaacgtggctattagccctacgatcccaactgacgaacagggtaacacggaactggagatctcttcactgactgcgggaacgactgaaattatcgctaccctgaacggggacagtcgcgttattccggtgaactttatcgacaaaaacgcaacataccactctcaggaaaaccgtattgtttacaaaggcgcgctgttccgccagccgacccacaaacctgctacgcaaactgacagcctgtggcacctgtttggtcagctgttccaccaccaccaccaccactaataagaattc

SEQ ID NO: 922 - DNA, 2105 bp, Artificial sequence; identical to SEQ ID NO: 921
  Optimized for E. Coli

SEQ ID NO: 923 - DNA, 3848 bp, Artificial sequence
  Optimized for E. Coli
ccatgggtagccgtctgaaactgagtcgcaaccagcaccgtgcagtttctggcgcaaacgctgaccagtaccgtaccacagcaccagtgtttggtctgatgacctcagcgcaccgtgcagccacaattctgctgtttattctgtgctttttctttgcgtctctggctcaggcggctgttaacaccggcctgtcaggtgacgaccgctacgcaggtcgttttccgattggctttgaatttcagtactacgacaaaacatacaaccgcttttacgtgagcaccaacggcctgattcagtttgccaacccgagtattgactacgacaacacatgcctgccgggtgaactgaacaacaccctgtacgtgttttgggacgacctgcgtaccaacgtggacggtcagccgacaggcaaaattgaataccagacactgggtgacgctccaaaccgtcgcctggttgtgcagtggacaaaccagtactactttggtacaaacctgccgatgggcacctttcaggcaattctgtacgaaggcagcaaccagattaaataccagtaccgcaacctgctggacgaacgtagccgcggtgacagtgctacagttggcctgcagggtccagaaggccagtttgcccagtttggttgtaacgaagcgaacctgctggaaagtggccaggccgtgacctttacaccgtctgaagacggtctgtcatacgttgtggacggccaggcggaatacgactttattgacatttctggctttacagttgactacccggcgctgctgtcagcttacaccaaccaggccccgggttgggaatggaaccgtaactctgacctgaacgcgtaccagattgacattcagaacgcagccggtgaatcagttctgcaggaaattgtgggtaacgttggccagtacatttaccaggccggtgacattcacggcgcaacctggcgtgcaaaagtgcgtggtagcattaacaacggcgcgacatgggaaatttggagtggtctgagcagtccggttaccgtggacaaagttaaaccgtctgcggctgtgtcagaatttcaccgcctgtctgcagaatcagcccgtatttcttaccagaccacagacgacctgagcggcgttaaaagtattcagctgcaggtggcgagcgacgcagcctttgaaaacgttgtgctggaaaccagtctgccggttaaccgcacccagtaccagctgacacagctgccacaggctgcttcactgtacgctcgcattcacgctgtggacaaagcaggtaaccgtagcgacgactctgcagttgtggaactgctgattgcagccccgagcctgattaccccggttaacggcacacgtgtggacgaaccgtttattaccgttagtggtattacatacccggaagcgaccgtgcagctgtttctggacggcaccgctctggaaacaagcgttcaggcagacgaaaccggttactttaccacagtgattgctctgggcgaagaacgcaactaccgtctgtctgctcaggctcagacaccgctgggtgcgtcttcagcttcttacgaagttcagttttcataccaggaagtgggtgcaaccgttctgtttgcggctccgaacgcagacgccgtgctgacagctccgaccgaagttacagtgattgcatctgaccgctcaggtattgacaacgtggctctgtacgttgacgacgcactgctggccaccctgacagaagcaccgtactcttttatgtggcagctgagcgaaagtgacaacggcgcccgtacactgaaagcgattgctaccaccggtaaaggcaaaacctttgaagcttcaaccaacgtgacagcagaagttctgccgccggtggcaccgccgaccccgtacaccggtaaagtgaactctgtttcaccggcggtttcttacggtgaaccgattgttattgaaggccaggccgtggaacgcgcgacatcagaactgatggctaacaccccgctgcgcattgttctgattaacaacggctttaaacgtacaattgcagtgagcagtgacgacaacggtctgtttcgttacagctttgttccgcagagtaccgacaaaggcacatacagcgttgctgtgattcacccgaacgaaaccgaaacagtggcacagggtaaatttaccattaaccgcgttaacgtgcacattggtggctacaacctgattgcagcccgtaacgttccggctaaaattgacgtgaaagcaacagccgacagcggtagtctgggcttttactggaccattcgcgcagaagaccagccggacggtcagctgccacagggcattcgtattaacagtaccccgacaaacattccggttggcagcaccacaagtacccacgtgacatttaacgccgacgacagcgcggctgaaaccggtcacctgtacctggttgcgtttgctaacgaaagtggtgacattgtgcgcggcaaactgcagattaaataccgtctgacagaagcgcagccggctctgtacaccacaccgggttttattgaaaccggcctggcgcagaacagcaacattaccgaaacagttacactggcaaaccgtggcctgaccacagctcagaacgtgaacctgaccctgcaggacgaacagggttctgcagccccgtcatgggtttttctggcaaacgaagccgacattcagacagttaaagtgggcgacaccgttgccgtgaacgttacagcgcagccggacgacagtgttgcggacggtatttaccgctttaacctgcacgtgcgtgctgacaaccaggcaagctttaacgttccggttgtgattagtgtgattcagaacggcacaggtggcgttcgctttgacgtggctgacatttacacagccaccctggacgcgaacggtcagccgattctgggtgttgcaggcgccaccattaaactgcagaacgaagctgctctgggctctcagcgtgcagcaaccaaccgtaacgcgattaccggtgaatacaccctgaaaacagacaacaacggcctggctgctgtggactctctgccgccgggtatttacctgtaccgtgcgtcagctccgaaacacgaagacgttaccggtcgtgtgcgcattcgtccgggcgttatgaacaacgaacacatttttctgaactacgaaatcatcaacatcgaattttctgtgacagaaaccacaattaaagacgtgtacgacgttaacctggacgttacctttaacgctaacgtgccggcaccggttgtgattctggaaccgcgcacaattaacctgtacggtatgcaggttggcgaagaaaaaaccggtcagctgacactgacaaactacggcctggtgcgtgctgacgacctgacctttaaatttccgcagtcagacgaacgttttcactacgaatttttcggtgacattccggaccagctgctgccgaaaacacgtctgattattccgtacaaagttaccaaactgaaagcttctccgtttccgcgctcactggtgaccccgctgagcaaactggcacgtagtaacaacgaaaactgttttgactacaacaacgacgcacaggcccagtacggttacacctgcgccaacggtgacacatcttcaggctctgacaactcacgcttttacgaacgtacaggtgaagactgtgaaccaggtgctccgtgggaagaagacgaagaaaaagaaaacgaaaacgaaccgaaaccgccgtctaccccgatgacagacggttgttcacaggactgcgaaggttgttgcagcccgggtaacggtgctggtaacagttaccaccaccaccaccaccactaataagaattc

SEQ ID NO: 924 - DNA, 1283 bp, Artificial sequence
  Optimized for E. Coli
ccatgggcaacaacattaccgaatacaacgacacagcaaactttgtcccgtacaacgtatacgcgaccagcgcttttgaatttgactgggacagcagtgcaattctgaaacaggccgtcctgaaaggtattagttttatcccttacgtaggcgactacctgtcttcaattatcggatttttctggaaagaccaggaacgtgacatttggcaagagatcctgggtcgcgttcagcaactgattgaagagaacgtgctgaaagcaattaaaggaatcctgctgggggacattgcagaactgaaaggcaaaatcgccagcgttgttgcagcactgcaggaccacccaggaaccccggaagccaaaagcctgtttatgagcgtcagtgtacacctggacagtgttcaacgtaaatttaccacattcgaccacaaaacaaactaccacattctgccgatgtacagcgcaaccgccctgatgcagatcatgtactggacaatgggtattgaacgtaaagacgacatcggactgaacagtaacgaggttgggcagctgcaacgcaacattaacctgctggttacgcacgtggaagactacgtgcagggtatttacgacactgaactggagatccaatacaacgactctgcgccgaacacggttgctaacaacgtcatgtacgtacacggatactgtcgtgtgcacgggctggaatacaccgagattatccagtctattcaaaacaacggatcaaacacaaaagggctgtactccaaaatcctgtcttactcaacgtttttcggttggcctacttcgcaggcacgcattctggccctgaaagacgaagtcaacatgccggagccttttaaaccaaaactgattaacgggcgtatcaaccaagttaaatcagtgaaaggttacattcgtcgcatcggtggcgcgctgcgtgttggagggctggaaattacctttgagaacggttccaaatactcgcagggtacggtcactggcgaattttcctcgattgacctgaacggctccgtaatcgaaacgatggagacttggggttcgggcgcgattgacgaagctaaatttacgctgtctgacggtcgtaccttcacagttggccagcgttactcaactaactaccgcaaatttgctctggaaggtcactacatttctggcattttcatcgcgtctgaccgtagtgagctggctggacaggctgctaacatctgcgtgtcataccaccagaaacaacaccaccaccaccaccactaataagaattc

SEQ ID NO: 925 - DNA, 443 bp, Artificial sequence
  Optimized for E. Coli
ccatgggatctaaagtgaccattacaatcgactctaactcaaacgaagtcgacgtaaaaaactcaacggaagcggacactgaatctctggctctgaccgcagcacaggtccgtacccgtgtaccaacagaagttgcaccgaacagcagtaccgaagttctgtaccgttcgactccgattatccctgaaagccgtcgcaacgtgatgattaccaacgacggtgcggctaacgtcatcacagcacagtactactggtcccactcgtttaccagtcaatggttcctgtacacatctattgacgttaacgtgggcgacagcaaactgctggttagccctagtaactctctgtactactcaaaagttgtgctgatcaacaacacgtcccgcaaagcatacgttactgccgaagagaaacaccaccaccaccaccactaataagaattc

SEQ ID NO: 926 - DNA, 1346 bp, Artificial sequence
  Optimized for E. Coli
ccatgggcaacgacgacctgccgatgcaggacgaagttcgtcagtctggcctggctggtgacatttacgacgtgctgcgcgaatcaattctgattggtgcttttgcagttccggtgattggtggctttctgagctttctgggcgcaagttttattccgagcagtggtgaaagcccggaacagatgtggaaccgtctgatgcgtgctcgcatttctgacgcactgctgcgtctggcacagcgtgacctggttggtctgagcgaagtgtctcgtctgtacaaaattgcgattgaatctggtaactcagacgaaattcgcgctcagtctattgcagccaacacccagtttacagcaatggttccgggctttcaagtgcgtggtgaagaagcggctctgctgccgctgtttgcaattgcagccacactgcacctggccctgctgcgtgacatggttctgaaaggccgcgacattggtctgtctgacggcctggtggctcgctacacctcagaaatggttgtgctgattcgtcgctacaccatttacgttgacacacacgcatcttcaaccattgacaaagcccgtcgcgacaacccgcacagcacagtgggcctggcgcagaacatgccgctgagtgctatgctgattgaaaaaacaaaataccagctgaccgttctggacctgcgtgacacatgggcaaacctggacccgattcgctacccgggtaaatctcgtattaaactggaccgcgaaatttttaccccggttattggctggctgggtcgtaaaaactcacgcccggacgttattccagtgtggcgtcgcccaagcagtccgctgtcttcactggaagtgtgggaccgtatgcagtggcgtacacgctttatttttggctttgacgccatgtacgaagacggcagcgttatgagcagtggtagtcgcatttctaactcacacaacgtgcgtctgggcaaatacattaaccgcgttaccgccgaagcggctgcaggtgtgtaccagatgcgttttcgcagcaacgacggccgttggacaaaagtgggtcgtgacgctgacgacgacaccccgattcgtcgctttgactcttcatacagtggtcaccgtctgagcagtattcgccacgtgggtattggcatgggtgctgctgaaggtgctgttcgtggctgtgtgctgggttttcagctgattcacccatctggtgctccaatgtcacgtgaagctctgaacagcatggccccgaaaattgcgccgcaggtgctgaaatggctggaagacgaagcgattccgaaccacggtctgattcaccaccaccaccaccactaataagaattc

SEQ ID NO: 927 - DNA, 1427 bp, Artificial sequence
  Optimized for E. Coli
ccatgggttctaacccgcagattgacacccacggcccacgtgctccaaacccatttcacggtcacgtgtttcagccggcatctcgctcatactttgcctacgaaaacggtcagctggacgttggcgctctgaaccagcgtgaaagtggcaaatttttcccggcgtctaacgctggtctgcgtgactcatttgctccagacgaccaggctaacgctcgtccgccggctgacggcaaaattgcatcagccgaacagctgacaggccagtttctggacgaaccgggcacccactggacaaaacacaaagttggtagcaagaaaaccctggacgttagttggtactttgcggttgctcacgtgacccgtcgctggaactactttattacaaaaccagactgggacccatcactgccactgagccgtgaccagtttgaagaaaaaccgttttacgttgtgcagattaacctggaaccgttttggtctcacagcagtgcaatgaaaccgtcaaacccaacagttcaccaggtgccactgccagaacgtacaggttaccacgtgctgctggccgtttgggaagtggcggacaccggtaacgctttttaccaggttgtggacctggaatttgcagccaccgaaacaccggttgttggtccaagcaccccggaaaacctggctgctagtgaaatcaaagaaaaatctgtgaaactgatttgggaccgtagtgaaggcaacgcagacgttgccaaatactgtattacacgcaacggtattaccacaattgacgttgcagtgccgaacctggaatggaccgactacagcgtgagtccggacacccgttacacatactttgttcacgccgttgacgttatgggtggcgtgtcagctccaagccgtgctattattgttaacaccctgccggaaggtggcattaacgcaccgccgacagcaccaggtctgctgcacagcatgaaagaaaccaaaaactgcgttagtctgatgtggtctgcgtcaaacagcgctgttggtgtggcaaaatacgttgtgtaccgtgaaggttcagaaattgcccgcattagcggcaaccagaccacatacgacgacgcgaccctggctagcgacacacagtaccgtttctttgtggcagccctggaccgtaacgaccgcctgagtgttccgtctaacgttctgaccgtgcgcacaaaaccagacgtgggtgacgactacccagcttggaaactgtctggtgcatacaaagccaaagacattattcgccacaacggtcagatttgggtttgtctgcagtcacacattgcatacgccgaagcttgggctccaggtgcaagtgactctatgaccctgtggcaggcatacgccggtaacattaaacagcactgcctgcaccaccaccaccaccactaataagaattc

SEQ ID NO: 928 - DNA, 1313 bp, Artificial sequence
  Optimized for E. Coli
ccatgggtcacggctttgttggtgacgactctggcaacccaacccacacactgacagctcgtgcagccctgaaagctaacggtgacatgggtggcgcccagtgggaaccgcagtctctggaagcgccgaaaggttttccagcttcaggtccggcagacggtcacctggcatctgctggtcacgaacagtggagtgctctggacgaacagcgtgaagaccgctggcagaaaaacgttgtggaacagggtgacgttaccgtggactggacatttaccgccccgcacatgacatctcagtggcgttactttatgaccaaagaaggctgggacccaaacgacgctctggaccgtgacgacctggaactgattgaaacagtttcacacgacggttctgcggcttcaaacaacccgtctcacgaaattaccattccgtcagaccgcgaaggctaccacgttatttacgccgtttgggacgtggcggacaccgctaacgcattttacaacgtgattgacgttgacgtgcagccagctgacggtgaaacaccggaaccgggtgaagacacagaagctccaggtctggtgccagacgcagccgttcgtgcagtgagcagtacagaagccgaaattacatggggtgcgggttctgacgaccgtggtgttgctcgctaccaggttgtgcagctgggctcaacacaggacgaatttcgcgtgctggaagaacacgctgctacagcacgttctacccgtctgacaggtctgcagccaggtgctctgtacagttttggcgttcgtgcagtggacgcagccggtaacattggcgttgcacacagcattctgacagtgcgcatgccagaacaggctgctgctccggctgctccaaaacacctgcacgacatgggtaccacagaaagtaccgttgctctgatgtggacagcaggtgacgacaccgccggcgttcgttacgaagtgtttcgtgacggcgaacgcgtgggtgaaacaggcgctaccaactttgttgacgtgggtctgcgtgcaggtagccgtcacgaatacacagttcgcgccgtgaacctggacggtattgcgagcgctgcaagtaacacccacgtggctaccacaaaaggtgacgcaggctctgaatacccgtcatgggacgcccacggtgcgtacacaaaaggcgaccgtgttacacaccagggtagcacctacgaagctgtgcagagtcaccagggtcacggcgacccgaactggattaccgcactgagtctgtggcgcccgctgggccaccaccaccaccaccactaataagaattc

SEQ ID NO: 929 - DNA, 1313 bp, Artificial sequence; identical to SEQ ID NO: 928
  Optimized for E. Coli

SEQ ID NO: 930 - DNA, 1370 bp, Artificial sequence
  Optimized for E. Coli
ccatgggtccgggcaaaaacatttctccgcgtcacggtcgcgttaccacaccggaatctcgcgctgtgctggctcgtcagcgcggtctgctgccagacgactctgttccgaacagtctggaagcaggcaaatttttcccgctgtacgccggtggcctgctggacccagtggctccggctgacagcccgagtggtaccccgccggcggacggcaaaattgcatctgccggttacgcagccggcgctattctggacgaaccgcgtagcgactggcagaaacacgaagttcgcagtggtgacaaactgacagttgcgtgggcttaccacgcagtgcacaccacacgtcgctggaactactttattacacaccaggactggaacccagctgaaccactgaaacgtggtcactttgaagcttctccgttttacaaagtggaattttcactggacccgaactgggaacacacagcggctctgaccccgtcagacccgacagttcacgaactgattctgccgcgtcgcgaaggttaccaggtgctgctggcggtgtgggaagttgctaacaccggcgcagccttttaccaggttattgacctgcagtttgcaggtgcttctgagggtcaggcaccgaccgccccgcagggtctgagtgctagcagtgtgtctaaatcaaccattggtctgtcttggctggcatcagcggcttcttcaggcagccacattgaaaaatacacaatttaccgtgacggtctgggctacgttgtggttcgcgacctggacgaactggaatacctggacaccctgctgcaggcagacaccacatacacatactttgttagtgccaccgacaacctgggtcgtgaaagcctgccgagtacccaggtgacagttcgcacatggggcgcaggtggcgaaattccggcaccaacagctccagctaacctgcacgaaatgggccgtaccgaaacaagcattacactgatgtggaccggtagcgttagtacccgtggcctgctgtacctggtgtaccgcgacgcggtggaagttgctcgtctgccgcagcgcacactggaatttaccgaccacggtctggccccgggcaacacatacaaatacgtggttaaagcaattgacaccgccggtctgtactctccggcgtcaaacgaactgaccgctaccacacagggcgtgccacaggttccacagtggtctgcaggtgccgtgctgtacgaagttggcgaccgtgtgagccaccagggtggcgtttacagttgtattcagcgccacgtgtctaactcaggttggtcaccgacagcagccattaccctgtggcagccggcgcaccaccaccaccaccactaataagaattc

SEQ ID NO: 931 - DNA, 1388 bp, Artificial sequence
  Optimized for E. Coli
ccatggccaaacacattaccaacccgattagtcagaacattacaccgcgtcacggtcacatttttagtccggcctctcgcgcgtactttgcttggcaggcaggtgacctggacgaaggtgctctgaaccagcgtgaatctggtaaatttttcccagctgtggcgggtggcctgctggacgtgtacgccccggaagacgttgcaaacagcccgccgccgccggacggtaaaattgctagtgcatctcaggctaccggcctgtttctggaccagccgggtagtcactggcagaaacacgaagtgcgtggtggcgaagttctggacatttcttggcactttaccgcaaaccacgttacacgtcgctggaactactttattaccaaagaagcctgggacccgagtcaggtgctgtctcgcgaccagtttgaagcggaaccgttttacaccgttcagattaacctgaaaccgtactggagtcacggtaacgccatgaaaccgccgtctccgacagtgcaccagatgccgctgccgattcgcgaaggctaccacgttctgctggctgtgtgggaagttgcagacaccgcagccgcgttttaccaggttgtggacctggactttgttggtcgtgaaggtggcggtggccgtccaaccacaccgacatgtctgaaagcaagcagtattaccgacaaacaggtgcagctgacatggaacgcctcaatttcttcaagcaccgttgcgctgtaccgtattacacgcgacggcagcaccacagttgacgtgtacgttccgctgctgtcatggaccgacaacagcgtgctgccgggcacctcatacagctactttgttacagctattgacgaccgtggtaaccagtcactgccgagcatggctattcaggttcgtacacaggcagaaggtggcggtacagcaccgccgacagctccagtgaacctgcactcaatgaacaccacatcaaacaccgttagcctgatgtggggcgcaagcacaggcggttacccgctgaaacactacaacttttaccgtgacggtaaacaggttaccacaattccggctagtcagacctcttacacagactctggcctgaccccggcaacaatgtaccgtttctttgtggctgcagaagacacccacggccagctgtcagttccgagcaacgtgctgagtgttaccacatctattggtgaaggcggtgaaacaccggaatggaaactgggcgaaagttaccgtgtgggtgacaaagttatttaccagggcgtgaaatacgcttgctttcaggcacacatttctaacgccggttggaccccggcggaaacagtgaacgttctgtggctgctggttcaccaccaccaccaccactaataagaattc

SEQ ID NO: 932 - DNA, 1403 bp, Artificial sequence
  Optimized for E. Coli
ccatgggtaaaaacatcatctcaaaaccgaaagaaggtctgagcagtcgtcacggccacgtttttagtccgaaatctcgcgcctactttgcgtgggaaaagggtcagattgacgacggcatgctgaaccagcgtgaagctggtaaatttttcccagcaaaactgtctggtctggctgacccagttgctccaaccgacgtgtactcagcactgccgccgcgtgacggtgaaattgctagcgcaaaccagggtaacgcacgctttctggaccagccaggttcagactggccgaaacacgacgttatttcttcacagctgctgccagtgcgttggcactacagcgccgttcacgtgacacgtcgctggaactactttattacccgtaaagactggaacccagacctgccgctgagccgtgaacagtttgacgaaaaaccgtttttcagcgtggaactgacagaacagccgttttggtctcacggcgacgcactgacaccgccgaacccaaccgaacacatgctgatgctgccggaacgtcgcggttaccacgttctgctggctgtgtgggaaattgcaaacaccggcaacgccttttaccaggttattgacctgaactttacagactcaaccatttctctgccgccgccggcagcaccagaagctctgcgtgttaaaggtgtgacaggcaacaccattagtctgacatggagtgctccgtctgtggcggctgcatactacaccatttaccgtgacggtgtttttgcggaccgcgtgaaagctatggaatttaccgactctggcctgaaagaagacacagaatacacctacgaagttacatcagtggacatgagcggtaccgaatcagctcgtagccacgcactgacagttcgcacccagagcagtgctgctattgaccacccgccgagtgctccagaaaacctgcactgtatgcaggttaccacaaactctatttcactgatgtggagcccgagtcagtctccggtggctattcagtgctacattctgcaccgtgacggtcaggttattgcccgcacaccggcgtcacagctgacctacgtggacagcaacctgcaggaaggcaccacataccactactacgttgtggcacagaacgaaaacggttgtctgagtgcgccgggcaaccagctggctatgaccacagaacgtacatctacaacaaccccggacccggcaccgcaccgtaaatgggcactgcgcagtaccttttctgcaggtgaaattgttagtcacaacggctctctgtggcagtgcattcagacacacgttgcatacagcccagaatgggctccgggtgcatcagactctgctaccctgtggcgcctgattaaagctcaccaccaccaccaccactaataagaattc

SEQ ID NO: 933 - DNA, 1988 bp, Artificial sequence
  Optimized for E. Coli
ccatgggtaatataaaaaaatatgccgataatagtaaaataatacatgtcaatcataactttatgcaagataaccaaagctccttaattagaacttttgttattgaagaagttaatgttcaatttataagattagtgtttagtttggctaatatgccatctggttcatacatagaaattactgatcgtaagagacaacatacacgtatctttccactaaataatggcgctacactggatgtaactttttataataattgtatcgatatcaaagttattttacccaaaaattatcactataataaaaatcaaatagcagagcttacttattatgaagcccttccccaagatctaacgcaaattgttgaagatagtcatgatgggcggcaaccttacatgtggtataaaaatacacctttttttaatccagttcgcgctgtccattttgctgcatttaatggttatggtggaagttgctcatttataggttcggctaatcacgtattaacaaatcgccatgtcgctttaggcgccaatagtcaaattgatccagaagcgataaaatccagtgaaatgtgggttaactggcacaatattactaacgacttttcatcaccgattactgatattatccattttgatatcgataaggtattaacctacggcaaagaaattggtggggttgaggattatgccttatttactatcacagattttgattatcaaaatgctcacgttaaaactttatttggtggtctaaagcttcaagaaaccataaataatgagcgagaaaatatctatattccgcaacatggtggagcaaaaccgttacaaattagtgcacggctggtaagttctatgcatccttttgcatcaataacccctcagccagagtatggtgatttattcattctaggagatatggaaccaggatcctcaggctcccctctaattggtcgcgaaacacacaatatattaggaattttatgggggcgatttttatttacccaacatggcatttcatcaccataccttatcgataaacttaaagattttatttctgatagtaatattcatatcaaagcacaagataatattgtgtcacataatattgaagctactccggtcgataatgctgaaattaaagtgatattaggtgataaagaacaattgattccttttgataccattcttgttgaaaaccatgatggctactctattgtcgaaatggctggattggatcttacaaccagaaaaactatgccagtaaaatataaagtcttggcaattatgtctaatcaccaggtaagccatcttaatgatcctgcgttaattggtgaagtaacgctgagatttattccttatcaacatctacaagacacggttattaaaagctggtttgttgctcgaatagaacgagatggagaaattgttaacaattacattactcgcatcttaagctataactacgatgtcttcgaaataccctttgatgttaacaatgcagattgcatgccattaatttttgatgccaagcaagctaatactattctacacccatttaccgaaaccaatcctaatttatcattttatactctacgccatgggcaaggaccagaaaatgttggtgaaattagtgatggttactcaattctaaaaacacaagtcattaatgcaaaaggtgaaaaagagctagttactttccaggcatatcggattaaatcagtaaccgcaagtgagccttaccctttgatctctactccaagcagaattaatgtaaaatgtaattatgactttaaaggaccatcatatttaagagtctgttattaccccgaagataatctgcatttaattggtaaaggaacatttaaaggtattattgcgctccatggcagtgatgaaagtggttctacagatcgtttatgtaaaaatattctattagatattacaatcaacggacaccaccaccaccaccactaataagaattc

SEQ ID NO: 934 - DNA, 3818 bp, Artificial sequence
  Optimized for E. Coli
ccatgggttttatgccattcagagaatttatttctagccatgtcgggcgtcaccccctcttcaaccgcgctcctgtcgccgtgattaatcccatcacattggcgattattgttgcgttctccacccttgccttaccacaaaccgcacgggcgtcgtgcaacaattcgggggggagtacctatatctgtgaaggtgaaaataacgccgggatcatcctaagtggaacggatatcacggttgagacccagctcggttttggcatcatagagcctggagatatagatcctgcgctctcattaatcggctctggtgccatcagctaccttgataccaacagttctgcgcttgataccgctggtgcctattctttgtctatccagaatgatacgtcgatgattgggcaatcgacatccactaacgttcaggccaacggttcaattggcagtggtatctatattagcagccagagtcgcgacaactcgaccatacaggtagacctctccggcatgttatccagcggcctgaatggcactcctgccctttcaatcgactcattggcagacaatgattcaactatcattctgaacatccatgctatttcaggtattgcgggtatccaaagcgataataattcacggtacggaacggccatcaccaatgttgatattgccaacgatatcaacgtcgaatattcaggagcctcgatccaaaattattccaatagtggcaccagcatccttaatttaaattcaaagagtatcagtacagacttcgacgccttggatattaataatagcaattattcaggggaggtgatgaccgatatcaatatcgatggcgatatcagttcagccaatagtcaagctgccaggatttacaatcataccaatagcggtctttcgagccttagatttcgcgcaaataatgtcacgggtgaatatgctggcctttatatcgataatagcagccagaatggcgctgtaaccgatattatattgacgggtgatcttacggctacttcaggatctgctctgtatgccaatacctactcggaggaggggaacgtcgagaccgctatcaagttgaataacgtttattctctgtatgacgcactcaatatttacggctataaccaaactggaaatacactgtttgaccttgatgtctcaggcacggttacttcagaaaatggtaccgggattaaagtgatgggaacgacttttgaaggcaattccactatactcatcaatgtgaataacattacttccagcagtcaatcgcttgatatcaacaattacaattcttcgggttcagctctttctgccattactgcaaccgggcatctcgctgcggaatggggacaaggggtaacgttccaaacctattcctctctgggggatgctaccacgctcatccatgtcaatgacattacttcaatggggaatgggatatatagccttactgaggctagccggggtacagtaaccaccgacgtcaccgtgacgggccagattaacgtcagtgatggggagggtataacccttaatacgcagaccattgacggcaataccctggtcaacattgacgtcaataatatcgccagtgaatacgatgctatccacctctataacaataacaacaccacaggcgtggataatggcacaggcgtagacaacggcacatcgaccattgatctgatcacccggggcgcgctggtttcgcagcagggctacgggattaatcttgaaaccaataccgcagacacctatgtcactgtgggcggcttggtgcacggcggcaacggctccgcaattggcattcatcggcttgataacattcaaacatcagccacgttagagctgcaatctggctatgcccttgaaggggcgacacagtcactggtatttactggcaattacgtggatatcaatgatgccgcgctggatctggcaaacagccatctggtgctgggcggaacaggagatgctgttttcgatctcacgcgtattgataaccgtgaagaggccattctggatggcgacccgaaccggatcaccggtttcggcaccctgaccaaaaccaacagcagcatctggacattaaccggatccaatatggccgacggtgacgccaatgccttcctgtcggccaatatcgccggggggattttggtgctggataacgccacgctgggcctgacacctgacgctggggcactgactggagccacagtaaaccgcctcagtgctgccgatatcgccgctgacccgacgcgggtggctaccgaaaccggtgcattaaccctggctgaaggcggcgcgctgtcctcgctcggtgactcggttctgagcggcaacctcatcagcgctggcgggatcctgctgtcaaaccactataccggcggcaatggtgccgctaccgatgatcggctgaccgtgaccgggacttattttggtgaaaataacggttccggtgaaggggcctggctggcactcgatacggtgctgggggatgacgattctgccaccgaccggttagtgatcaacggcgatgccaccggcaccacctcggtccgggtgaacaatgcgggcggtctgggcgataaaaccctcaatggcatcaatctgatcaccgtggacggtctggcgcaggatgacaccttcctgctggccggggattatgtcaccacggatggctatcaggcggtggtggccggggcgtatgcctacaccttacaggccgacggggaagccgctaccgcaggccgcaactggtatctctcgtcagaactgatgctaaccgagggggtacgctatcaggtgggggtgccgctgtatgaacaatatccgcaggtgctggccgccctgaacactctgccgacgctgcaacagcgtgtcggtaaccgttacggggcaccgggtgcgctggcagacctgaactttgacgataatcaatgggcctggggccgtattgaagggagccaccaggtcaccgacccggcccgctccaccagcggttcacagcgtgagattgatgtgtggaagttgcagaccggcattgatgtgccgttgtatcagagccagggcggttcactgctgaccggcggggtgaacttcacctacggaaaagccaaagcggatatccactcattctttggtgatggccgcatcaacagcacaggttacggtcttggcaccagcctgacctggtatggcaataacggcgtgtatgtggatggccagttgcagacgatgtggtttgacagcgacctgagctcccgtaccgcagggcatgcagtggccagcggtaacaatggtcgcgggtatacctcggcgatagaagccggtaaaggttacgcactgggtaacgggttgtcactgaccccgcagatgcaggtgacctactcgcgggtcgatttcgataccttccgcgatccgtttgatagcgaagtctcgctgcaagagggtgacagcctgcggggccgcattggtgtctcactggataaggaaacgacctggagcgcgaaagacggcaccacccgccgctcacacatttacagtcatctcgatctgcacaatgagttccttaacggcagcaaagtacaggtctcaggggtggagttcgccacccgggatgagcgtcagtcggtggggttaggcgcgggtggcacctatgaatggcagaatggtcgctacgcggtttacggcaatgtcaatctgctgggggctacacggaatatcagtgacaactatgccgtcggcggcacgataggtgcacgggtgagctggcaccaccaccaccaccactaataagaattc

SEQ ID NO: 935 - DNA, 2978 bp, Artificial sequence
  Optimized for E. Coli
ccatgggctacacttacgccaacagcgtgcacaaatctgtctactcaaacaacccagtggaacagagcagtattggaatcctgtccacatcggtttacccggacaacgcggttgtgaaatacggtgaaaaaatctacattaactacagtttcaacgacaaagctcacccggttctgattaacatctacaaagacggtgacctgcagtctgactactactacgaacaatcttcatggggtgaccactttagttacgagcctaaagacgaaggttcttaccgtttcgtcgtacagccaaccgaccaaccgtactacacaaacgaatgtaccgttacagtgtacaaagaccgcattatctttctgccgggcattatgggaagtgagctgttcctgggcgacgaacaggtttgggaaccagagaactctaaaaacctgccgcgtattcgcagtcagatcaactctctgcaaatgaccacactgggtgaatcaaaaaacaacatctccgtgcacaacagcattagtgactacgacgacatcctggcatttttcaaaaacgaagggtttcacgttgtggacttcccatacgactggcgtctgggttcctcgattaacgcacagaaactgaaagagcgtattaacatcgaacgcgcagcctccccgtactcgaactactacattgttgcacactcaatgggtggcattgtggccaccgaatttatccgccagggcaactccaacctgattaagaaaatgattaccatcggcacaccgttcctgggagcgcctcaagctatcaacatgctggaaaccggcaacctgacagacaacctgctggctgtgctgctggcaggagacgccgtcaaaaacctggagaaaaacgtacctagtatttacgaactgctgccaactaaagactacttttcttaccagaccaacgggtacatcgaaacgcagacttaccaagacccgtacggtcctcgtatgaaagtgcgcaaatacaacacgttttcagacactgaatcctacattaaaaactcgcgtgactggagcaacaacggtctgtttgacaaagcgaaagacttccactcggctctggacgttctgaacaccctgaagaaagttgacagctactttattgtcggcgaccagaaaacgactcctggaaaactggtttaccactctctgtcaattaacgacaaagtactggcagacgttaaaagtatccagggtgacggcgtcgtaccagtaagcagtgcgacagttggctttaaactggacaaagctcgtaccttctacattacacgctcgcacctgggtctggtgaaaagcaccgaagttcagcaaaaaatcctgaaaatcctgaaagacaaaccgaacgaatttgttagtgacaaaatccgtaacgaaaccaaagagatcaaaacaatcaaattcaaagcagagtgccctgtggaactgcacatcaacgactcttctggaaaccacaccggaccaactggtgcagaaacctttgagtctaacattcctgacatcaactacttcacggacggcgagactaaaattgcgctggtcaacgacgtagaaaactacaaagttcgcatcgtgggaacggggtacggtgaactgacttttagtattgtgtggtctaacgagaaagacatcgaagaccgtactatgcgctttgacaacgtcgcagtaaccccgggcagcattttcaaagccgacgttaaccagaacggacaagttgtgctgcagatcgaccaaaacggcgacggaaactttgagggctccgtgtcgcctacagtcgaactggacctgggagggacgcaggacgagaccattccaacaatctcctcgcacgtcgacggcgtaaaaggaattaacgaatggtacggtaaaaacgccttttacaacctgacaggcgcggacaacgcttcaggagtgtacaaaacgttttacgacctgaacgactccgaatttaaagagtacaacgaacctattgcgctgccaaacactggcatctacaactttaaatcgtacgttcgtgacaaaaaccgcaacgacagcgaggtgctgaccgaaattgttaaagtggacaccacatcaccaacggtcccggtaatgactgtcgacccgacgacttggacaaacaaatttgtaaccattacactggacggtggcaccgacgctgactctggattccagaaataccaatacaaaattaaccaggacggagagtggaaagactacaaagacccgtttgtcatcgacacggaaggtctgtacaacgtatacgcacgttcagttgacaacgtgttcaacctgtccggggaagtcacgggtgtaactaaagttgacaaaaccaaccctcagaaaccactgatgaaagttgagccgctgaaatggacgaaccaatcagtggaaattactctgagcggagggagtgacaccgacaaagggtttcctaacagcggttttcaaaaataccagtacaaaatcgggctggacggcgagtggaaagactacacagttccatttattatcgacaacgaaggtctgaacaacgtatacgcacgcgccgttgacattgcggctaacctgagtgacgaagtatttggggacgccaaagttgacaaaacccgtccgtctaaacctacaggctttgacattgacctgttcaactacgacaacgttcgcatcagctggagtccgagcagtgacaacgttggcgtgaccggatacgacatttaccaggactcaatcctgctggacaacattacggacactgcgtacactttcaacaacctggaatctaacaaatcatacaccttcaaagttattgcatgggacgaggccgggaactcttcactggaaggtgtcaacgtcgtacgtacaccgctgagcctggttgggaccggtcgtgaccactccctgcactcgatgggtagccaccaccaccaccaccactaataagaattc

SEQ ID NO: 936 - DNA, 2978 bp, Artificial sequence; identical to SEQ ID NO: 935
  Optimized for E. Coli

SEQ ID NO: 937 - DNA, 1097 bp, Artificial sequence
  Optimized for E. Coli
ccatgggtcctaacctagaaacaggtgtcgcctataatattgcactaggaacgaatccaaatttagtatttgatattttaggaaatagtacggaatatgatgcattagtaggtttatatgcaaaaggaaataatagtatcaatcaacaattttacttttttgaattagatggaggaaaacttgccgtcgttccaagaaatagtggcagaccgcttgaacctggatttggagaccagccagagaatcggattgtgcaaggggcatggacgggtacaattagtcaacagtgggcgttacaggatagaacggcatccagtgttcatatgtttaatcaaagtgatggggccgttgcgagttatggacggaacgaccaagaacagtttcctgaattgaatccacctgatccatcaggtcccaatcctgaaagagcttggtatcttgaacctgcttatcaagcgctattaccaaatatggtttcgacaacacctatcccttctccaccagaatattcttctggtatatatgaagtgttaccagaccaatcagaagtggctactgtatcgaatgctttgatcccttgcattttagtcaatgacggttctgtaagtcctgatataaaagtgcaacaatctccctattatttgttgatcaaacaacaatattggcaaaaagcagtattcggtaccgtttctccaaatactacaagagaatttttgtttcaatccggtaccacttccctagatcaacaatcgatgtcggatacaatcaatatgacaattggtggagatttcggattacaatttaataaggtaagtgcacccgctaagtttgtcatttctaaccaaattcaaacagtagtcagtacaacaaacgaacaattatctggatttacagacacgattgaatataggaacattaagaaaaatgtcttagtaggtgtttcgatctatcaacttgtgacacgatatgttttatatcgaacagacggttcattagtcgcagaaccttggaaatttattgataatgcatccgcagtgacgattatcactgagcaaccaatcgatgcacaccaccaccaccaccactaataagaattc

SEQ ID NO: 938 - DNA, 2411 bp, Artificial sequence
  Optimized for E. Coli
ccatggcttcaagcgagaaagaaataataaacgaccaagaagcgaattttaaaggcctattgggctactacttcaatgataaagagttaaaagaaaccgcactgatttctaattctgagtctggagatctattcgttgataacgatcaaatcgatgatatgttacctgatgaattaaaacaatttcaatctgccatgtggagaggatttattaaggtagaaaaatcaggtgaatatacgttctccacgtctgataatgaccacaccatgctatggatagatgatcaccaagttatcgatcactcctccgctacgcaaaaaatcgaactagaaaaagggaagctttataaaataaaaatcacttatcagccagaatcctcctctgctaacgaatttggcttacagcttaactggattactccacaaggaaaggaagaaatcattccagagggaaatctactgcttcctgacataaaaaatcaaccagagaatgaatctagcagaaaaaaaagaagtatttcagcttctgatgacggagttgaagatagtgatggtgacggcatccctgattccctcgaaatcgaaggatacaccttggatgtcaagaataaaaaacttatcctgatgccttggattgaaaaagtccatggaaaaaaacgcacgaaatctggagcaccgttaacaaaatatacatcttcacctatgaaatggagcaccgcatctgatccatatagcgatttcgccaaagtatcaggaatgattgataaaaaggtaaaagtgaaacatccgttgatcgcggcgtatcctaatttacaggttcatatggacaaatttattatttcaaaaaatagaaatgaaacgctagaaaatggcgggaatacaagtagttcgatcagtggaagtacttccacaagcaatactcattcaacagaagcttctgttggggcggaagttcatgcttccttatttaactttggcggaagtgtatccactaattttagcgatagtaattcacagaccgtaaccattgatcgttcaagctctgagagtttgggaagaaactggtccaagtccttaggtttaaatgcaggagaggctgcctattttaatgcaaacattcgctatgtgaataatggtacggcacctatttatgaagcagcacctactacttcactagtactagggaaaaacgataccatcgcaacgataaaagcaaaagagaatcacctagcaaacgtagtgttaccagaccgtttttatccagataaagatcaagcagctatttctctacaaaccaaagacgatttcggttctagcccgatcacaatcaataaggatcagcttactattctggagcagacacagcaaatgcgcttggaaacagatcaggtttccggttatgtaggagtaattgatcctaaaacaaaattaattgtggtagataaagataaacagtggagtcatattatccctcaaattgaggaaactactgctcgactgatcttaaaaacaccagacaattcagagctggaaagacgagtagctgctgttgatcctgatgactacactgaacaaacgaagccagatgttacattaggagaagcgctccaattggcttttggttttgaggacaagcaaggaaaattatcttacaacaatacgagtatagatgattttagattagtgtttgatgaagaaactgctgaaaatatagaaaaacaattagaagatatggaaacaaaaaatatctataacgtccaactgcatgctcgaatgaatatactaatttcaccgaagaaggatgaacctggtgttcatgaagggttatctagctgggaaatagatggagaagacaattactataaatatgatgtgctgcaaactggctggcaaacgataaatgggaaaaagtattattttaatgaaaatggcactttagtacccaacaaagtaattgaggatggaacctatcaaatcaatacagcattaaaaaatacaagtctagttgattggaatagaagcgataataatatcacagtgtgggaaacgaacgatggaagtaatcaaaaatggaaattgaagtatgatgactctcaacaagcctatgtgattcgaagcgtagaaaataacgataaaattatggcttggaatgcttatcagaattctactaatgtatttgctacagcatttgaagggaaacccgaacatttttggattcctgaattgctaggtaatgatctctatatcttaaaaaacaagaaagatccgacaaaagtgttggatgtagatggttcaggcacttcaaacgggtccaacattcaggtaagtgattataaaggtactgataatcaaaagtggaaattagaacaattagaagcaaatcaccaccaccaccaccactaataagaattc

SEQ ID NO: 939 - DNA, 1889 bp, Artificial sequence
  Optimized for E. Coli
ccatggcaatccgatcccatgctccatcagtttatgtaacaccacaaaatactgctgcttcagatattattagcatagactggtcaccagtcctaacagcacctcatacgtattgggctgtgcataactggaatcaagggggagagggtggtggttatgctggcttccaacaacaaagtggttttgatcaaaccggtaaacgtactctccattttgcgctttgggatccaatagcatcaaaccaagcaataaaagctgaatatttatcgccgatttcagaagccagtagatttggtggagaaggaacaggtctgaaggtacaaacaacttataattggaaagatagtgaatggtatcgaatgactatacgttcttggcaagaagatggccatacaaagtttggccagtggataaaagataataaattaaatcaatggaagttagttgctattatggatcatccagttgcgaatgttgcatttaaccatggtctatcgatgtttcaagaggactgggctggtaatggacaagatgtaagagaagcacgccttaaaaatggatacagcagaaaagtttcagatcaacaatggaattcttggaataatcagtgtatctctgggcaacatgatacgtcctatcaatacgatggaggagcaacttcagaatatatctgggttaaggcaggaggaaatactcaatcaactattggtactggaaaaaattttaatataaatcagccgagtcaaccagaaatgggaattctagattttgatattcaaaatattcgctttgaagataagaaattaaatgtttcttggaaattgaaagaacaaagtactccacaatttaaagggaaaattgaaatctatgataatgaaaagttaatgggacaacctttgaaagtcattgataatattaagtcctaccaaactgaggtaagtcaaactatgcaattgcctcaaacggcttttgctaaaattacattaacagacatatttgatcgaactgtagagaaaaaagtaggaattacaaatggaaattctgatattttagtagggaaccaatttgcatgttccctaaaaggatatagtgatcgagaaattgcaaaagtagattataataaagcggcagaagagttaaaaatcaaattagaagctggcgtaccgcatgcttactttaatagtacatatgcaagtattaaggttcaaaactcatctggtagcgtattatacaataaggaaatcgtggggaatagacaacaaaataccgaaagtcaaactgtgtctgtaaaagtggggaattacattgaattaactcatatagaaggagacgcagtaaaggaaaagacacgcgcaacattaacaaatcttgaaaataacaaaaatgagactattggaaagacagcaaggtatctggttactaaagagggattaaagaaagttgaaaaaatgccagagacaacaattcttgatggaaaacaatttgcatggtcattaaaaggatatagtgatcgagaaattacaaaagtagattataataaaacagcagaagagctgaaaatcaaattagaagctggcgtaccgcatgcttactttaatagtacatatgcaagtattaaggttcaaagctcatccggtagtgttatgtacaataaggaaatcatgggaaatagacaacaatatgctgaaaccaaaacagtacctataaaagtgggagattatatagaatttactcatatagaaggggaagcagcaaaggaaaaaacgcgagcgactttaactaaccttgagaatggaaaacaggaatatataagtaagaaaagaacatatcaggtcacatccacaggattaataagacaacaccaccaccaccaccactaataagaattc

SEQ ID NO: 940 - DNA, 896 bp, Artificial sequence
  Optimized for E. Coli
ccatggcagcaggcgtaacaaatacggctgcaacagatgcgggtatcgtagattggtcgactcctatcgatcatgcaatggatatatatgggcagcatgcaggaaagccaggaacctatggggggagtggccttcttggaggttttactgatgtgaagtatcgcgaattttcggtagaagcggatggttcgccgatcctttcgaattcgaaaacggtatttgtgggatcaagcactttagttaatgattcagatatggagcaaacgctgagcacagacagtttcacacagcagtttaccaattccgtcactagctcaacgacgactggctttaaattcggagaaaaaatttcttctaagtttgagattcctctcgttgctgaagtgggggcagaagtatcgactgaatttgatttttcagatacatccagcaatacaaagactgaaactcatacttacacagctcaaccacaaaatataaaagttccgccacattcctctgttgaagttattgtcaaactggatacagtgaaggcgagtggaaatgtaaagctgcttagcaaaatgtcaggccagaagaccgggtctattatttattataatcctagtgttcaatatttctacaatctatcatttcatgatatcgtagacgaggcttcgaaatatgaaaagctatcaaatgtgtatgcaaacccagatgaaacgatcactttagtgggcgcaggcaattatgaagcagaatatggcacacaatttatggtacaagtaatgaagccgaagccactaaatgaaaatggaagagtaaaaagagaccttcatgaagaagactacgcttatgaggtaactccggtagtgaataaagcagaacaccaccaccaccaccactaataagaattc

SEQ ID NO: 941 - DNA, 896 bp, Artificial sequence; identical to SEQ ID NO: 940
  Optimized for E. Coli

SEQ ID NO: 942 - protein, 427 aa, Artificial sequence
  Optimized for E. Coli
MGKLLELKSVYSEQEQERFYTRSISLGDWDYSAIIKSSVMFGLGQIPVVGKALSTIVGLFWPKNEKDVWQKSLDELREYIDNQILATIQGILNGELREIQKKMEYVARLLEESPGSPEACSEYKNLQFYLVGKDEKFRSFDELTNYKLMPMYASMILLQASYWKMGIDKKDQIGLSSIDLNSLKNHIDDLADSSRNYINRIYETELDRTYENSRPDEVANNMFAVRGYSLLHGVEAVEVVKNIRDLDFDKRFNINVISYSTAVGTITGGMIAQALTPDSEMAQPLCPEVFGQQANRIVQIIGYSGPRINSLFRIGGLEIIYENGDSSLLGERVGNRDVFDLNGSLIKTVEMRYQGLMDEVKFTLFDGRVMQVGQGESYSGYVKYEVEGHYISGVFLSRDRATYPGRTSTASVSFNMVPAISHHHHHH

SEQ ID NO: 943 - protein, 139 aa, Artificial sequence
  Optimized for E. Coli
MGKDQFSNNEIEKLSRGVGLETSPADESVQLLSGGTFTVPKHGSVQAAKYSTPVIPEIHKSYWIFNAGKANKIKAVFYWSHSFTSSWFEYSSVEVGIGEEKKLQAPSNSLYYSKVVLFNGTDQNATVSVTVAKHHHHHH

SEQ ID NO: 944 - protein, 366 aa, Artificial sequence
  Optimized for E. Coli
MVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKEHHHHHH

SEQ ID NO: 945 - protein, 1217 aa, Artificial sequence
  Optimized for E. Coli
MGHHHHHHDERASRPRFYTPKASGDRASFRTSEFYANWGLNLHHFDAAYAAGATGQNVKVGQLDNPLYVKHPELAGINFSAVGSYPLATTPAFDAGTGKPAYHGMHVAGIIAARKDGKGMHGGAFGATDFVTGNFRQTSQAVQQAGGTLSKLGKTIVDAGADFINHSYGYNFGIYAIPMALPEGQFGSHGPDIRHMQRYRDRQHIELSSANGVVNVSSAGNDRYYAAYKTAFNKYDARPRLFRGIGNGAGINSIPYMNHREKNLTDADWSRIEKGILSAVILNGTKDINSYSNICGISKYWCVGAAGGMLTEPDKAYATTLPALPYPVDFYHPDASGQKYSYEKLNGNISSDRYRILSLAVTSNAPPGSPEAEVMDPKNLQPIYRMAMGTSMAAPTLTAGLAVTKSRFPYLQNWQIRDIVLSTAQDIGAPGIDRVYGWGAMDLEAAIGGPRSLFALRRDYIEKLAQYEVEAADKYNPIVAKADYYATQAYELKIQMIENAKRAAEAEKAGNQKEAAQLLALNKQLAPQEAAFRKQAYEHELTRIQPNNEADTPQNAFEYINFVVNIPGKKSEACAEDACVADVWTNDISGPGGLEKKGAGLLALAGNNHYTGGTKISDGVLQFGIGGTTGSVTGNILNNSSLVFARSDEWSYKDSITGSGEVLVLGGGTFRLQGDNTYTGPTHVYDGRFAVDGSTISNTIIYGGGTLSGNGRVGGIHVRQDGIVSPGNSIGTLTVMKSGSAGAGAGNAVFEPGSRLAIEIDGQGNHDALKVENAANIHGGMVDVGVANLSRTQLAQQVRQSMQKPYEILTAGAGVSGAFDQARLDIDLPFIAAGLRYSPQTVGLVLGRSHLGFGSVGQTYNQRQIGDGIESLSPGQPLYDGLLTSASRQEAVSSLQQLSNVDIHASLKRTLIDNTRFMRDAALGRSGFASMPNIGASADGKLLGETNMNVWGKVLGSWQKHKGDGNAASLDRTIGGLIFGVDHLMNRNWRAGALVGLSNSSLKSDRASAKIDSYQFGAYAATERERLGLRVGASLAHHEIATRRGGYPDLTSMNKADYSANSLQVYGELGYKFTANAVMIEPFVNSAYVHLRTNAFEEDGDASKVSGKRQSANVVSSILGARISNIVESGSGTAFRLSGMIGWNYNVGDIAPIASVNYRGGNTFDVRGIPLSRNAFVTEVGIQASPKKNLSAGLYYDGRFGRKVSDHSLSLGISYAF

SEQ ID NO: 946 - protein, 1217 aa, Artificial sequence; identical to SEQ ID NO: 945
  Optimized for E. Coli

SEQ ID NO: 947 - protein, 1223 aa, Artificial sequence
  Optimized for E. Coli
MGHHHHHHDERASRPRFYTPKASGDRASFRTSEFYANWGLNLHHFDAAYAAGATGQNVKVGQLDNPLYVKHPELAGINFSAVGSYPLATTPAFDAGTGKPAYHGMHVAGIIAARKDGKGMHGGAFGATDFVTGNFRQTSQAVQQAGGTLSKLGKTIVDAGADFINHSYGYNFGIYAIPMALPEGQFGSHGPDIRHMQRYRDRQHIELSSANGVVNVSSAGNDRYYAAYKTAFNKYDARPRLFRGIGNGAGINSIPYMNHREKNLTDADWSRIEKGILSAVILNGTKDINSYSNICGISKYWCVGAAGGMLTEPDKAYATTLPALPYPVDFYHPDASGQKYSYEKLNGNISSDRYRILSLAVTSNAPPGSPEAEVMDPKNLQPIYRMAMGTSMAAPTLTAGLAVTKSRFPYLQNWQIRDIVLSTAQDIGAPGIDRVYGWGAMDLEAAIGGPRSLFALRRDYIEKLAQYEVEAADKYNPIVAKADYYATQAYELKIQMIENAKRAAEAEKAGNQKEAAQLLALNKQLAPQEAAFRKQAYEHELTRIQPNNEADTPQNAFEYINFVVNIPGKKSEACAEDACVADVWTNDISGPGGLEKKGAGLLALAGNNHYTGGTKISDGVLQFGIGGTTGSVTGNILNNSSLVFARSDEWSYKDSITGSGEVLVLGGGTFRLQGDNTYTGPTHVYDGRFAVDGSTISNTIIYGGGTLSGNGRVGGIHVRQDGIVSPGNSIGTLTVMKSGSAGAGAGNAVFEPGSRLAIEIDGQGNHDALKVENAANIHGGMVDVGVANLSRTQLAQQVRQSMQKPYEILTAGAGVSGAFDQARLDIDLPFIAAGLRYSPQTVGLVLGRSHLGFGSVGQTYNQRQIGDGIESLSPGQPLYDGLLTSASRQEAVSSLQQLSNVDIHASLKRTLIDNTRFMRDAALGRSGFASMPNIGASADGKLLGETNMNVWGKVLGSWQKHKGDGNAASLDRTIGGLIFGVDHLMNRNWRAGALVGLSNSSLKSDRASAKIDSYQFGAYAATERERLGLRVGASLAHHEIATRRGGYPDLTSMNKADYSANSLQVYGELGYKFTANAVMIEPFVNSAYVHLRTNAFEEDGDASKVSGKRQSANVVSSILGARISNIVESGSGTAFRLSGMIGWNYNVGDIAPIASVNYRGGNTFDVRGIPLSRNAFVTEVGIQASPKKNLSAGLYYDGRFGRKVSDHSLSLGISYAFHHHHHH

SEQ ID NO: 948 - protein, 1223 aa, Artificial sequence; identical to SEQ ID NO: 947
  Optimized for E. Coli

SEQ ID NO: 949 - protein, 1216 aa, Artificial sequence
  Optimized for E. Coli
MDERASRPRFYTPKASGDRASFRTSEFYANWGLNLHHFDAAYAAGATGQNVKVGQLDNPLYVKHPELAGINFSAVGSYPLATTPAFDAGTGKPAYHGMHVAGIIAARKDGKGMHGGAFGATDFVTGNFRQTSQAVQQAGGTLSKLGKTIVDAGADFINHSYGYNFGIYAIPMALPEGQFGSHGPDIRHMQRYRDRQHIELSSANGVVNVSSAGNDRYYAAYKTAFNKYDARPRLFRGIGNGAGINSIPYMNHREKNLTDADWSRIEKGILSAVILNGTKDINSYSNICGISKYWCVGAAGGMLTEPDKAYATTLPALPYPVDFYHPDASGQKYSYEKLNGNISSDRYRILSLAVTSNAPPGSPEAEVMDPKNLQPIYRMAMGTSMAAPTLTAGLAVTKSRFPYLQNWQIRDIVLSTAQDIGAPGIDRVYGWGAMDLEAAIGGPRSLFALRRDYIEKLAQYEVEAADKYNPIVAKADYYATQAYELKIQMIENAKRAAEAEKAGNQKEAAQLLALNKQLAPQEAAFRKQAYEHELTRIQPNNEADTPQNAFEYINFVVNIPGKKSEACAEDACVADVWTNDISGPGGLEKKGAGLLALAGNNHYTGGTKISDGVLQFGIGGTTGSVTGNILNNSSLVFARSDEWSYKDSITGSGEVLVLGGGTFRLQGDNTYTGPTHVYDGRFAVDGSTISNTIIYGGGTLSGNGRVGGIHVRQDGIVSPGNSIGTLTVMKSGSAGAGAGNAVFEPGSRLAIEIDGQGNHDALKVENAANIHGGMVDVGVANLSRTQLAQQVRQSMQKPYEILTAGAGVSGAFDQARLDIDLPFIAAGLRYSPQTVGLVLGRSHLGFGSVGQTYNQRQIGDGIESLSPGQPLYDGLLTSASRQEAVSSLQQLSNVDIHASLKRTLIDNTRFMRDAALGRSGFASMPNIGASADGKLLGETNMNVWGKVLGSWQKHKGDGNAASLDRTIGGLIFGVDHLMNRNWRAGALVGLSNSSLKSDRASAKIDSYQFGAYAATERERLGLRVGASLAHHEIATRRGGYPDLTSMNKADYSANSLQVYGELGYKFTANAVMIEPFVNSAYVHLRTNAFEEDGDASKVSGKRQSANVVSSILGARISNIVESGSGTAFRLSGMIGWNYNVGDIAPIASVNYRGGNTFDVRGIPLSRNAFVTEVGIQASPKKNLSAGLYYDGRFGRKVSDHSLSLGISYAFHHHHHH

SEQ ID NO: 950 - protein, 1216 aa, Artificial sequence; identical to SEQ ID NO: 949
  Optimized for E. Coli

SEQ ID NO: 951 - protein, 1402 aa, Artificial sequence
  Optimized for E. Coli
MGFEAARVGDDIGHSGALAGMIAGTIVGGLIAAAGGILAGAMFIAGLGASCLGVGVLLVGASLAVGYYTGELATAARDSIADAGASSMTKKGVITSGSPNVFINGKPAALATDSTVDCSDDGSQQMAEGSKRVFINSQPASRIGDRTTCDAKVMTGSDNVIIGGDPQQTLPIQSEVPEWLYKVSDLTLLFAGLLGGWGGAAGKVGALSKLLGKIPGINKLARIACRAGTLMTGVAAAGIIARPVDIVSGQKFLSGDDELDFVLPSRLPVRWQRYWRSGNPGDSVLGRGWSLFWESRLEPYQDGLVWRAPSGDYIAFPNVPKGMRTYCESEKNWLEHHSDDSWSVYDVSGERWHYAPLKDDAPSLLQRISEPCGNAILFEWNANNTLHALTDSAGQRVVCRYDSDRLAGAWLDDEICLVSYAYDEQRQLVCVTGRGGSVRRRFRWQDGLMSAHEDANGLLSEYRWQEIDGLPRVVGFRHSGGEQLTFEYDFDNGTRRATRDDGAQAHWLVDDDDNVARFTDYDGRQTTFVYRDGELCDVILPGGAMRRSTWDKYGRMTSETDPAGRRTEYHWYRLTDRITRTVYPDGTSSQAMYDLRGRLLSETDPAGNATAYDYPDDQENLPESITDAIGGVVRLVWNHQGLLTQRTDCSGSVTRFTYDRFGQLIASENAEGNITRREWSRAGLLSAVIHPDGSRESLVWNERGQLTGWRDPLESEVSWAYNALGLPVSLTDRIGRVRQWRYDPRGNLLRLDNGNGAEYRFTYDAVGRPLSETRPDDTVRHMEWDARGFLCALEENGRPAADGGIARRVQQFSYDDSGLLIGRTQRHAEYRYFRDLSGQITRIRRTPTAEGVALGIESDEIVYRHDANGRVLSESGINGAVGYEWDALSNLTGLTLPGEQKLAWLHYGSGHVSAIRFGQQLVTEFTRDRLHREVRRTQGAREQLRQYDSLGRRTLQRSELSTDVTLPEKALLERLYRYTARGELSGVSDTLRGEVDYGYDAEGRLLKHYEARQGHSRAQFSYDAADNLAASDDAAPVTDNRLQHWQALFMKYDHWGNLVSRRNGLYEQHYAYDAENRLVSARGTGPEGRFEARYHYDALGRRTRKIVTTTHGTTETRFLWQGYRLLQEQQESGLCNTYINDPNEAWSPLARVDHLRDQNSGEIYWFNTDLNGAPLEVTDERGAVRWSGQYGSFGEVRHQSEGFSRLVNRTAMAHQPLRYAGQYADGETGLHYNLFRYYDPQVGRFIVQDPIGLNGGWNLYQYAPNPLGWIDPLGLLTYNTMPSITGFQKHHIIPQQLKGHDLIKAADFNIHDIKNVIYLPKSADYHPTRTIHSGSHPVYTKNIGDQMDAIYEYGKENGWKQAEYKQAVSEIIKNERADLRGGKTILNKNSVRKARCHHHHHH

SEQ ID NO: 952 - protein, 538 aa, Artificial sequence
  Optimized for E. Coli
MDPASQQLRDQQQAQRQREQLQQLERLQRLQPITSHDDRSAFTDTSDNCWSITGVRLTGNQKLPTHQLQPTVQALSQPCMGIASINQLLKGLTQQYVEAGYPTSRPYLARPPKHEQPLDIVIIEGFVESIELTDGELPLSLQGAFPGLLGKPLHLPDIEQGLDQLNRLRAYDLGIELLPGELQGGTRVVLQPRQVTSPWHLDTRLDNRGSELVGRHRLNLGLGLDSPLGMNGDLRLSMASTVFNAPGQSRGLNLYYSLPYGPWTFTLNASRMSYRAPVPESHIVSNGKSRFLGLGAERLLWRNQRGILSASARVDRKQLITRSDSTVISLQSPTLATLEAGLNLLWIDRGLWNAYLGVSQGMDWFGADRPLPQAQTPRPDFLKYRVNLLHLRQGPGHWPWRWQSELTGQYSADVLPAVEQFQLSDDSAVRGFRQHTASGASAAVWRNTLSQPLDLAWTHSVQVRPTVGLDLGWTRFARASASQRLAGAAAGVELSLPQSRLRLDYQRALYASDKPAKGLERGYWVLDWTLTIHHHHHH

SEQ ID NO: 953 - protein, 538 aa, Artificial sequence; identical to SEQ ID NO: 952
  Optimized for E. Coli

SEQ ID NO: 954 - protein, 1049 aa, Artificial sequence
  Optimized for E. Coli
MGTIPERRLLPNAADKTALKAIATSIVQTCPSLLDAARQVAIELLTDKGLSGLDPDEVYFHRFKTAQSSTLTFTGWEHLLEKPYETLTLTQLVIHRFRATDQDNADLLGLYCGFYSDGPDAENFNQDNEVRLLGSDVLKAFWAVDFSTRYTGQLTKFWQTSSEDFRALAKCNFLSQAVQALQEGDVDGNDFQRIVTSLIGPITWPITLQMLRATYPVGAQVRTLDLDGHVATNVLRLVEDSGRQTLYLPGEPQAFRLMDTAADLHWWLLDQMNSEQKRPLFLKHFSLADSNHITENLTDLMNRLVSTWGHSDHRMINRSNVAISGDAFTWLSESTRAGMAAEAHLVLTSNSDLRKKLWTGYLSAGLKVFGPMAAVGWPVALPLIGAGIANMGLNIDQAINGITAAERRAGVIGAVLSAIETVFNVPFLIGTGAQLEVGPQVEYAGAEEMLGLIELSSADTPSLPPVDPPPVTGTEAATSELTNEIPEEATSVTATELLTMTATRHGPTFPEVPASYRCNELLAQHSVEATPGKYEGIYRLDKEPGYAIEMDGQAYYVRYFADSQDSGNWAIVNPERPNQFAYSLPVRFGSAGKWERMPALRLRGGGQCVGKACAPETEVSSSGGTPSVEMRCLEPLPGVPCPLRLVTKLKGVSEKEKPGMRRWAMNLPSASAESAGARRRFLSTTERYVEHFSEERRALLNKAEKFHRELKWINLPERPDIPQISPQMQVDDLIDRIFANTDGLAVGETLDRIASMRFMIENMPAFARHIQTLYVRGLLSDFAQNDLNQFFLSGDMSEDLRTYLSGLGTDPENRFNVLELVKTAQANGIRVHGLDAAHTYTLKRPLLSIEEQMIKTRLSTTIIEGDKLLNRTKKWVALVDATNINMFRDLPGISELRGGIGLRIEEVWPEETADISIDPGVEVARGPFYNWAMTSNAFDVLFADLRLQIKSPMPQWNAAALEKLLHRNGMFVIQKTEPDIYTLVRRNSDSDIVRTRVHCTTAGRFYIWDLSMPRITGRNFHDIAAVAERLIELGFTLQSRLPTHHHHHH

SEQ ID NO: 955 - protein, 1557 aa, Artificial sequence
  Optimized for E. Coli
MGPIKIATKGNTTVDVHLRPDTPVDPPALRPDITLRPGLEAETLTTPPRPGSTTGSADADAIGLAPTVTVHPTRSGQDSVDLGDRSLEHYRLSLTPSLPAANTEGLRLFKGRQYVELADGGLVQVGKESQSGLWRATLASELTPTGPAMLRNPDDGLWHAFEHSQPTTFALSATRLEDFRTALDFSSAIGDSDGLHRFEGKLYAVIDNHAYQVLQDLDASTPWSQVMRIVRAEDPVAVDADNHYVASRPGRSQAIVLDPSEGWVGVSTGGAGGMRRAERNPSARRSLAERFFAFTHRSSRPEARVRKLYPSFDDQQVAAFLRTLGDDVDGGLTTKETEYSNLEKDLQAWTATHKHLTVPSAQGPVTNWANTVANGIKRCWSQETTQLRFPLSHAPLPALRADFNHVRFLEMDSVAWSPAAETFLSGFSGLQSLKITRSGLEKLPAAVSQMHNLTELNLRTNKLQLDEASAAALGGLANLEVLVLTKNPLGKLPDFSAMPNLQELDLCATGIKGWPTGLKGLTALKKIDLRHNKLQEVPAEHLNPADDQFEAIVHINRHILLENNAFPADYWQNFERFWLQAEARKAEWAAGALEGAFRLKEGIGVIDRTRNLYAHLDVAGAKKFIMGLGDDTDAVLTRRSEAFAQLDTSLDAYKQSCALLSNAGQRKRALETATAIRQCWLDQTQTTLTLDYLGLVGISNKQTMLPDLSADFGHVRKLTLIGVEWSPAANTFLSGFSHLQHLSIGNSTLDKPPTMLSQMQTLTWLNLGSNQIELDAQAVATIAGLNRLTHLNLSHNPLKITPDVSAMSGLTTLNLSHAQISHWPLGLLNKTALTGVDLGSNLLTDVPEAHLNPPADQLAAVARINNVTLLISNPGIPSSYVRKFEGYWRRLNTAHPELMTPVHPSAFDHDKSRAQRYHRLYPAKSINDCRKYLWGLEPGTVGTRLSQLEREFAVLNQQLDAWVFSGGGNRQGYIPANQLMLNAENRADRTTARDRIINCWRQETPQQTAFDGTSIGLELDLSGLNLPSLPDIDADFSHVGSVKLRDMHLSASPEGFLTRFRHVRWLDLSKNQLRVLPPAIGQMNGLTKLFLQHNEISLTVDTARILSERTTLRALWLSNNRQLGIVPDFSRIPDMRSVNLASTGISEFPVGLSAQPSLDTVNLSNNRIEQIPDFVFDAVPFQVNDVTNIRFNQLNNQSRARLVEYAGRLAAAGMFMSGRNNLIDTGLSMNMPNIRALLLDTMTRWTVGLPATEVATRRQQWQTVRDEQGSDGLFNTIDRLLSEPASHPDLQRRVWNLIDSITENTAQSEHLRREVLDRAGDPACCDRAAFTFTNLEVLTLAHKARSQARDEAQGKQLSALSKALFRLHEVDKIASADIAQREARIAASRTPEEARLFGPPRVPEEIEVRLFYRFRLKDRLQLPGQPERMGFARLADVSEAQLNAAYEKVIAQDNSPEEFQALVAREFWQEFITHKYRSQFETQRDPFQTRQATLDDAHSASELSFVDYKAQSMSLQAELAIKEAELITTLSRQELSEYAMQNSETAAVETEHHHHHH

SEQ ID NO: 956 - protein, 146 aa, Artificial sequence
  Optimized for E. Coli
MGMPLPVVPSQPSVNPDVVNVQYYRDYDRGPRRGYHNGYRGYREPRPGYRHHDGYWFPLAAFAAGAVIGGAIAAPNYRPAPVYRPAPVYRPAPVYRPAPVGNLNPRHYDWCAGRYRSYDAYSNTFQPNYGPRRQCLSPYFHHHHHH

SEQ ID NO: 957 - protein, 146 aa, Artificial sequence; identical to SEQ ID NO: 956
  Optimized for E. Coli

SEQ ID NO: 958 - protein, 441 aa, Artificial sequence
  Optimized for E. Coli
MGSSTLKLNDGLSDIGSIIHYGISQIPVIGGVLSTIFGLLWPTDKEDIWSTIKQEVQSLINEDIQEDDWNRLVAAVSELQDKVSFINDQLINAQYDTAGPELMTVVVDIIGIEENFKIEGTNFKYAFAPLFVAAVNLKIALYLEGIKYSNDLGLSQDQVNQLKSLLQKDVQSSKSYLSPINSAIGNTYLNNIQTYFSVKLYYETSVSLFNELWSGDYEDYNAPAPLENYYVPVMAAGSFYKLISLDGQNFSVPMAFAEVADNSMMPSTNILGSLYQEPTSYPDGYINFIDVYTDLSVSHRTTGLMFTCSGSDEQYEMGMTPNNNDSFNVGQNTMSINVEGGEFINQVSVRADSFVSQIEFTTNLNNTMVAGQHPDDDPIQEVTLVSPFSINSMYVVSDVAGYIQSSGHQMCGIAISAIYNNELAMQYVSSLYKNSHHHHHH

SEQ ID NO: 959 - protein, 107 aa, Artificial sequence
  Optimized for E. Coli
MGSTNYVIQPLETVTVWDDAEPIIPTVTKSVIVTNNGETKLEVVNYWAPPSHVFYPDTTYWVEPNDTIIVQAPERSFYYYRVNVTNSDDTKVGAAIVEIVDHHHHHH

SEQ ID NO: 960 - protein, 1479 aa, Artificial sequence
  Optimized for E. Coli
MAEIWAARKDDELIHTSALADIASAVAEVAVYAVATAAVSAAAAAAAPALAGVAVLGAAATAASGCVGAGLIVGFATSLTGVGEHISNGCDAVANWLFPPSVSGVILTGSPNVFTNAKPAARAAGRLLTPAEIKALPAPQPPQSFWDYGAELLAAGGNILSQLWQPGVAGPSQPSQPLEEDKISCDKHPLPQYLAEGSSKVFINGQPAVRSNDRSTCEAKVSTDVSKNVQIGGGTVVVRDIKSGKLPGIGLALTVLPLLLGNPAKLVKNLPCMIGGGLAAAGVNALGEAIHAAFNPVHAATGAKVLNDEEDLDLLLPARFPLIWQRNYNSRNGYQGLFGHGWRTPFEIWVDLNDRDGVIECCLHDETGRELRFPLPEVNQPSFSAGEGLMFRRGEEGQLLIADTDGSVWRLFVPLPQTPSRLRLVSLSDEYDNALLLNYDERQRLSHIVDSAGTMTLRLEYGDPRFDDRVTALRHNDEPRVRYRYDGGGDLHQVIDAGGLVTREFHYNAQHLLTRHQQAGGPSFAYRWAMFDDWRVVEHRDSAGGGCTIDYDLAAGLTTVTEYDGLRHQHRWNAQRLIVEYTDERGEVWHYQWNDEDMLIATRDPLGHGWHFRYDEAGNLVEEEDPLGHIRLTGWLPQRALPISVKEPNGATQHFYYDERHALIAEIDALGHTQRYLRDGYGQVVQAVDANGGISHFAYDEHGQLLRARDCSGKQTLYKYTAQGWLSEVTDAAGERVHYRYDAAGRLTQLQRAEGWQETLSWNAQGQLDRYQGADGRLTHYRYDAAGRLLATRNPLDGEVVRHYDARGRLTALRNENAESYLFHWTACNLLQEEIGLDGVSTRYRYDECRRVVERRFAANTSAAFSHYFSHDGAGQLVSKQTPDGETRYRYSPLGQLLHAASYRGNAWHDEPTTAQSEVSFDYDLLGRVTREQGANGTLRYDYDPMGNRTQTTLPDGRTLRALYYGSGHLLQLALDEITLSEFERDNLHRELSRTQGRLTSRVHYDRLGRKDRREIFNDNRQRPAPASSSRQWSYDYQNNLTREEHNANPFSYQRYQYDATGRLLSRDGTRPDTERYRYDPASNLLDEGQFRQRHNRVLHYQGIDYRYDVFGRTVEKRKGHYRWQYLYDADHRLCEVVRYSQHRSEAQQHVHFHYDPLGRRTQKRVWQQSQDLRQPAGKCQTTTFLWEGFRLLQETRDGMPLTYVYADQGSYEPLARIDGHAPAQVFYFHTAPNGEPESLTDSDGTLRWQSHSSAWGRIKYEENQQDLDYSQNLRLQGQYLDRETGLHYNLFRYYDPDIGRFTQHDPIGLAGGINLYQYAPNPLGWVDPWGWKPRCAATKANDHNQAAFGRQWQGRGIYKGRDSWSNIMLKEGDIVYGGAPGQSGFYFNKATLDAAGGSRAKLWESLQVLPHEKFGYRSKIQAYRVKRETIAGTGKAISQDPTRFGEGGGTQFFLSNYKTVLEPIDKPFEIGLHHHHHH

SEQ ID NO: 961 - protein, 121 aa, Artificial sequence
  Optimized for E. Coli
MGSDLEVKIGVNPADVRYTANFKVAPNDGYVMYEKNTPIIPEIGVNITVINTGREEMEVHYEWAPPFGGWQCASTTIIPPDGKPVYIAHPSNAFYYQRIIAYNKKESTAFGNCEYHHHHHH

SEQ ID NO: 962 - protein, 434 aa, Artificial sequence
  Optimized for E. Coli
MGNNEYIVTMEKKNNIELKSSGRYTLDDFYHDHAYAFKVALTIGLKKIPYVGSILSTLVKILWPTGASGESLQNLWEMERNEIQSMIDEATLHTINDILNGIVNSLGDKIADINRTIENYGFAAAKDDYINLISNYIIGLEEQFKFESEGSEFIAYATMPLLSITVGLQLSYLAFGLDNKANFGLDSADIDKCSRNIDEIYKDVKKYIEKYAKWSDSDSYSNANSENIYNEVMGSRAFCALNGFEHIEIWSEIQSRKSLDFSIISTSVSYSVEVGVLTPNMTRMATAVEVGPPLLPVMVDGHRNKIVKIEGWDSVEINSYRRVGCLKITYENGDVYDMGVKTSNPVSISLDGEFVDTVKVVQGDTYAINYIKFTLTDGRTMSVGEQSGDTQLLGFDNHTIAAIFVDEGSSDKISCVSVSCIPKQYEEEHHHHHH

SEQ ID NO: 963 - protein, 464 aa, Artificial sequence
  Optimized for E. Coli
MGNSESNTALDVTNVVSPMMTRGKSKVPLPQWEWDNACDIKYWMIKLAGFIPEVGAILSTMLEVCWPSKKENVWQQILHEVENMIETSKLTIIQGVLRGFINEMEGKVTHVQFMLETHPGSREAHDAYMSLARYLIGMEEHFCSFDDRTNLQIMPMYTASLMLQVMYWSIGVHKSQEMGLTAREVEEMQDIIDRLVDRSSAYCHALYDTEYDEIINTSDAYDITNDLLSVRGHCLMHGIEVLEIVEQIKARGSKENIILKTLSYSEVFDRVTPKTKLQALTEDDNMVAPLKPAWLGNNYAQIRSLVGYIVRIGGAPRVGGLGITFTDGNTYQLGTITREYRNLELNGSVITLIETWGSGAIDEALFTLSDGRTFSFGQRYSYNYRRFEAPGHYITGLYLASDEPSLRGQAAGIMASYHLRNDPATPSTPVSSVPRPLKSLPRRVAVSVSAHGEGRTRDHHHHHH

SEQ ID NO: 964 - protein, 146 aa, Artificial sequence
  Optimized for E. Coli
MGTISITVSVSHNDVEFDGGKLDRLRHGAAIAADDHTARVTEGEMRIEPRSSLQATRTDTPIIPESRGRFYVANAGKAKQVTAVFYWSHSFTSEWFEYSSTVIARGTDGIVMPPSNSLYYSKIVIYNDTDDVAFVTAYTLHHHHHH

SEQ ID NO: 965 - protein, 458 aa, Artificial sequence
  Optimized for E. Coli
MGTTTIISTKKNGPGLRHGHVSTPESRAYFAWQEGRLNSGQLNQREAGKFFPATASGLTDSVAPTDSTNMLPPPDGKIASANQGDGEFLDEPGTHWKKHSVESAELLKVTWYYSAPHATRRWNYFITREGWNPNMPLSRAQFEDKPFYKVELEEQPFWSHAAALNPPNPTEHLVMLPQRSGYHVLLAVWEVANTGNAFYQVIDLDFIGDVSPTTPVAPGGLRASASTTSSITLKWNAAASAAEYRLYRNNTLIYSGDQLSFTDNGLPENTTYSYAVSSVNEAEVESAFSQPITASTSSDVNPDTPPTAPTHLHSMGITTNSVSLMWGASSSSVKLNGYLVYRDGNEIARVNVAQLSYTDTGLRPATAYRYFVVAEDIQGQLSGTSNVLSVSTDKDEDDSGGGTYPHWILGETYHAGDIVSHNGKNWVSYVTHVAHSPDWAPGLALSLWYELIHHHHHH

SEQ ID NO: 966 - protein, 997 aa, Artificial sequence
  Optimized for E. Coli
MGQNNDKIPQVVLPTPQAQLYEKYVNHPTVEYTGTPEITIPLYEITVKGLKIPISLSYHAGGIKYGQFDGDIGAGWTLSTGGYRVSRTVYGQPDEQYDMYDPNELEEMWNRPWTGDIRKKIERDTYFMGLERKLHQEAYVRTQDSQHDLFNYILPTTTGQYIISDKRNKTVVTDKQNGDKIILDEGGSLSLNSMKIIDTGGFTYLLGGQQTNPSALLVETTLIPGTSASFADKAGWPLRQIQSPYGGNIDFTYKLYELPSENRFGGSFTLTDASYFIASAATGPQYSTASGSVSLSNGRYKQYYIEKITTDKETIIFKRLGFSVPGVSPANTHALSEIEIRAKDNTLVKKIIFNHKKSPEGNTTIDGFWHMLLTSVSISNGTGEPQTYSFAYNEPTLSSPVYADQWGYYKNAYEGRPGGRIIWNKLFLHKEFADEVLMPWTNPNHSYEPTPLKYVWNGTYPGTASYNFVDRSNNSSAGLHFFSLSRITYPTKGSIEYAYQPNKYEAGGETISGSGQRVWKIISNTEDGKPSIVTEYTYGKNGDGLGSVSSSAYLSDRFFATTTILSEIISSDVTLVSSNKFSQVRTYSSSPYQADLLDLMTVVYPEVTTSQYDTSSRSYNGKIVSTYHIPFKIGCSSIGGTSIQLGNYPPPTKYWNDYYINIYNFGNQPYLKSRVTYNNSNLPLIRESFEYENLKSQIFKGIRAIQKQSCVDRPVFLYYELYESPYTYIDPMCIADRIETTLNFNRIKSKEVVSFEGSDSIKVTETYQYDALNRVTRSVTTNGIGSTRQIEYTYPSSGQLVTKNKIGEPVRTKTINNNIPTGIVEKTYPLNAINPSSLRSSTGNESTLRTDITYNQYDSKGNLLQYTRADGTIVSYLWSYNYQYPVAEIVNASYTTVTNNLSGVTAASLAGNANPDDTVLSAVKALRTLLTNAEVTVYKYRPLVGIIEHTDPQGISTWYDYDDLGRLRETCFKEFGIKRILESYDYNYRNQHHHHHH

SEQ ID NO: 967 - protein, 997 aa, Artificial sequence; identical to SEQ ID NO: 966
  Optimized for E. Coli

SEQ ID NO: 968 - protein, 166 aa, Artificial sequence
  Optimized for E. Coli
MGQEDTYRGDGLNLYAYCANNPVTYFDPSGNNGLLNCPQPGFAPGNGDPETLYHYTNEKGKDAILESQELFPSLKANNPKDARYGNGQYLSDINPTTTKPASLASKFIRTPNKYKYTHFVEIDVSDLNVVRGRDGVFVIPNNNSLDISGRIVSSGKVGSQHHHHHH

SEQ ID NO: 969 - protein, 705 aa, Artificial sequence
  Optimized for E. Coli
MEETSTVDTSSTEQTSQPATSEVEDSTQVSSTDQVTTPSIHVSEPAASEEPTEPSNEPEQEVTSEAPKISALAAVGDGTEANPYRVTTFQELKDALGTLVAAGQTQYIQLQNDIVYNATGISITQNTVIDGNGNALLYSGTTYDPAQFRTGANNISITYKNLSFGNSTYPNSTWYGILYTGNSGVNFTVENINYTIKNGNQPFWGNNGSGNKLTFKGKNNFYSSGSSYGGEFVEGYPTVVFAEDSETTVYNDSPNATGVFYSTGQSVTVEKRASVSIESSKDYLFYNSATLNVQEQGKFSYKTIRGTNYSSNTATLCVGTLTANFANDSIGHFTTDVNSFTGSNPIVNLNSPDYVVFDATSSSKKVIDTMNPIFKRTDSDTSLYKIAYLTASGQNTYVPKVNSGSSYTVTSSNIGNGYSVAYAKMPSIEAPAVTAATGPDISNIAAQINNAAPATTLSSKVQYKLANKQLYSGDLAADAAQSSIEQAETADDGIIEKKELALPGDGLPIGDDTKHTFVHLPPGNYHVYAKTNDQRVAGYTFESLWKESTAEVQPFIQVQFSSNAMSFNSPIPGQFGKQQNLDNYTIRNAGNVPTNINLTSITRNSDSSEKLSLVEQFDTNNQELLLSLIAEKAGSGTRTTFGPLVDKDPLSLDTLQLDPFWEADAQADLYLAGDYSGPMIGPQNFSYRFSFAISAVTTNHHHHHH

SEQ ID NO: 970 - protein, 705 aa, Artificial sequence; identical to SEQ ID NO: 969
  Optimized for E. Coli

SEQ ID NO: 971 - protein, 229 aa, Artificial sequence
  Optimized for E. Coli
MGFRLYEEFKTIEEGKTWGEKYYMAWCKRIIDDPKVLTCNHQDKANPDNDYSFTETKLSIFHAYMGNSAKQFINPSLRNQCITEFENFYISNLAESLDLAPKLDRNIVVYRFVNRDIAEQIEKSSRFNKFTEKGFLSTSLTKNRSRKYDTDLVLLKIYLKKGSIGAYIEPLDNRGLEQEFLIQKGSKLWKKKKIKQQQLIATSLLNSPSFKIDLLECYCITNKHHHHHH

SEQ ID NO: 972 - protein, 412 aa, Artificial sequence
  Optimized for E. Coli
MGTQISALHLAAESTQPPLHMLTLQALNMIPPASFSASAMSPQGIATTILSMVLKLVYKKMTEPKEVDVIGIIQETLMKNTSEWLESEYQAVRKDAESLQDAISSWQNSPTEEARQLIVVRNEIAVADMRRLCILSINTAKSRGIVRLCGVCALSCLLYFFTLRDTLVFGKSWGYASDVLEKYSKALTEQADIMFKDVLTAEINNYTENDDFYDPESQAKRSVIYWTSGYTNIQEHLTYGAQQKPTRVCPERSDISANPVDGENHTVYLGNLFLTDSNSSADGSYNYLSAAEPRSYDRSGDPVRLPVRSAGLYHIRLYYAYMTNSLSFDYETQLKIEQAGKIITDAHLTDLTKTVLTPYKSGSNYGPVIYRETQLHLEEGDIVLTFHEDRSLSGGGLLQHVEFVKVHHHHHH

SEQ ID NO: 973 - protein, 937 aa, Artificial sequence
  Optimized for E. Coli
MGITPQISNIHAGTPTITAFDNRHFTVRTLQYYRQPNIQQDVQERLEFHYFNIYGFLQKNADARLSESGQDNFYYHADLMGFSLLNKGVDSGEIYQLNDIEQRLMVSIDANKTFKWCCYEANDSLGRLESVSEKIEGGNWRVSERFQYAGNSHTEQLANLAGQCISHFDTAGLLQTQEVSLQGEPTLLTRQFIQQVDNAEFNVDWQEDSDLTALSPEKFSHQTHFDAAGACLSIIDAKGHKQQREYDITGQLIRTTFTVKGQDTQPITQIIEYSAVGQKVREIYGNGAVTEYVYEAQTQRLILIQTYRPVNHSLGYKLFQSLHYDYDPVGNVIAIYNSAEKKVFWRNQKVEPKHRYQYDTLYQLVHATGREIAGISQQSHYLPHHSSIDNSVYTRYFRAYSYDKGGNLIQIHHRAPAMQQAYTIKMTTSSRSNHAVLADLAEFPHQVEPLFTPSGQQKQLLQGKNLTWTSRQELQSVNGAGGNEFYRYDGDSQRALKITQYNQKQSKVVYLPNLEIRQIEHNEKYHVICIGEDSEVQAQVLHWEIGLPDKMVNNTVRYSINGLTSNSGLELDMDGNLISQEEFYPFGGTAVWTVSSALEVNYKTRRYSGQERDITGLYYYGRRYYQPWVGRWLSADPAGTIDGLNLYRMVRNNPLTYQDEHGLAPRLFDTQDDMFADFQQTVSKLLNASSKIERIAKNPSLIRNRVISMAQLFYKDKTSKFTYAINLYEFLEMDSQSEEFKTWATNKLSYQNTSRQRQPGWETVNHAEQALIRTLTAHDSFNISNLIISQKAKLCSSCENAMYTFRQSMPKRRFTTMILRDGDLPLAAIQHGQSRTRYKNSSYSAGVAVGKTSFTLYDYKDIEFQVGMGNFWGGMDKTLYTMYANEFERVFGNLPIGKGVKKSFPPKPPKSSGGRGHQLDKNQPSTSRRHRHHHHHH

SEQ ID NO: 974 - protein, 526 aa, Artificial sequence
  Optimized for E. Coli
MGNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCQFYFYDTGDLDLIVNHVQPGDIVSLDIQFSVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESAHHHHHH

SEQ ID NO: 975 - protein, 526 aa, Artificial sequence; identical to SEQ ID NO: 974
  Optimized for E. Coli

SEQ ID NO: 976 - protein, 693 aa, Artificial sequence
  Optimized for E. Coli
MGQITYLDDLPTLGSNAFQFEGTQSGDSTERFLAEYGQNAANFVSEEKKQKKLADMAQDYARHKAANIATDEITQWLSKAGNTRLNINLNEKLSIKTSQLDWLVPWYDQHDFLLFSQHSIHRTDGRLQSNNGIGLRHFHQNSMVGINAFFDHDLSHYHSRLGLGLEYAQDYARVSTNSYLGLSTWRSASELAYNYYVRPANGWDIQLEGWLPAYSNLGANLKLEQYYGDDVALFGTNERQKNPMAATVGVNWSPFPLLALNVEHRIGNNGANETGAKIAFNWLLGRSLEQHLDTSVIEANRHIPNNRYDFVNRNNNIVLEYQKKTLISLSLPKVIQGVTGEERSIIRNLTTKYPIEKIVVDAPELIAAGGRLHLNGIDSSVKLPSYKITNNALKNQQLNLYRLTVTVYDTKGNVSPQVETLIEVTGTGALTITHENTKKRNNGIADGKDANTFAIVIKDPLGHPVPNAKVNFVLPANLRSIDQKNTGYYSLLNHFMWKAKAKKAVSEQKYNIIANDKGEASIQFTTFISGSYVVKANTEYGPEINEMYHFKPDISQSFISSIDIIRNNVAADGISKNKIKLRIINNSRQSIAGALVHFEASNGIISPANLTDEYGNTELEISSLVEGSIDIIATLNGDSRTIQVNFLKYAPTSYIQPSTESLFKPSINEQNRHTSLSLLRELFQKIGHHHHHH

SEQ ID NO: 977 - protein, 693 aa, Artificial sequence; identical to SEQ ID NO: 976
  Optimized for E. Coli

SEQ ID NO: 978 - protein, 721 aa, Artificial sequence
  Optimized for E. Coli
MERPSYAGAASDKPSYTTEQAAEQITRTGYRWKERNPDGTTPISYRFFTPSQATYNTPAGANEFSKHQKEQARRALQSWADVANISFTENAPDANGHLILGNDPQTGLAGYASYPGVYNNGTQAWFASGGSNYFFTHGSVSRYVLAHEIGHTLGLMHPGKYNNGGSYAENARYAEDTRAYSLMSYWWAGHLGHDHNKNGQTHYASAPLMDDITAIQKLYGANYKTRNTDTVYGFNSNTGRDFLSLDSPDDAPVFNVWDGGGNDTLDFSRFHQAQTINLKAEHFSDVGGLKGNVSIAKGVTLENAIGGTGADRLIGNHADNRLTGGLGQDILTGGPGKDTFVYNNASESTEQRPDRITDFTSGEDRIDVSAALRAAGLKDLHFVRRFSGRPGEALLGYDPRSGHHSLAIDLNGAGQADLFIKSQGPIKPGDVISQASHASTAPTRPFQVTPQPPTPAKTAPYEPRRETMALPQQAPFSLQNHANATLKGTPMHTAARAVGSIREVSVSRDSWGYERVHTRSLGTGSLINDGNSVLTNQHVRDALAKGSKLELWLGYEQDSAGRMKVERKVPLAPTPLSGDARLDYAELPVDLPAGEKKALAEQFPPLKLAPGPQASLGQKVFMPNHGQEALGISFLNAKGQPTTLKGYDQGSPYQGTVYHDAFKKPGTSGSPLISVDTGEIVALHNGSISANVNGHRASMGTATRIDLIQQHRRKRHHHHHH

SEQ ID NO: 979 - protein, 721 aa, Artificial sequence; identical to SEQ ID NO: 978
  Optimized for E. Coli

SEQ ID NO: 980 - protein, 545 aa, Artificial sequence
  Optimized for E. Coli
MGQGAVRGRRCTWDVRGRPWLTNSGHAGTIVILAGKDLVPVAKNSYGVGASTQKSKRSTPMSSEFRNSHLRNPVAPIEDPGRRRLMQSALAGSACLVAAPLLAHQGLVDSWGEPIGREAKASAGDDALTVLRESLLAGLNLVPVVGGVLSYLGALFIPAVGNSAEQLWREIVDARISEALLQLVKADLFGLTGIVQLYADAVRSGDLVAISTQSIAANTQFVGAVPRFAQVGQEVSLLPLYVIAASLHLALLRDMALKAVDLGYTPAYRSTLEAQAKDCIARYTAHVDRYVAAAIQAARVNNPYDWRKGDYYESNKPLTQMLQVKAALQIAVIDMRDTWYAFDPVRFPAPVAVRLNREVLSPIIGKWDRKNISPDALPTWQPPASRIKELGLSTFSTAGGASWLQGIHVVYQDGSELETGSRATQGKRLFLRNTSFHLSRVRARYLQGITRLEVDHNNGTFWQGGGPNSGANTASISYTGHRVSSIRSVGHGRAPALTSVGSLIVGFQLLNQEAVPISLQSYDRLAPNMAPQLLRWIADHHHHHH

SEQ ID NO: 981 - protein, 879 aa, Artificial sequence
  Optimized for E. Coli
MGNYNFTHKMKTKSIQTLSVFFVLISFFSYSQKQKRLITNYILTNQIRDFKKSDLIDFGIDNVDQSKSLKGEIVKIQQKFKRLPVYNAVGTALIKDEKIAYFSSSFLKNYNTSTSNIATLNKEKALERIAIALGKEDIKSFQIIENPEPAPAHRNFVKQNLTFVEVDNNLKLAYQFYLHEPKSQNSWNILVDANSGEILNKENLTVSCNFHPDAYGHDHSNEKFSESINKIFTSSSFLAPDNASYNIFPLPIEAPFFGNRSVVNNPWILTASPEGWHSDVTNHYTNTRGNNVYAYEDTANTNQPGFSPDGGASRNFNFPFSVNGTPSFNRNSAITNLFYINNRVHDIFYQFGFTESARNFQQNNFGKGGAGNDYVLAESQDGGGLNNANFTTPSDGSRPVMQMYLWSTVNRYFFYNAPASAIPRIPQANPAQFGPQLNGTGVTGEIALASNINGCSALPAGSLAGKIGLIERGGTANCTFAVKVKNAQNAGAIAAIIYNNAAAVNFPSSMGGTDPTITIPSVLITNDEGEYVKTQLNNSVIVNVTLKSDPATALTPDGSFDNGIITHEYGHGISNRLTGNGSTCLLKSQSKEQMGEGWSDFFALMLTNRLGDNANVPRSIGSYASGQSTNGAGFRPAKYSPDFSINDYTYGDTNGMEIEEDSEIVPDVHRIGFVWATMLWDLHWQYAAKYGYSSDVTSNMSNGSARVLQLVTDALKLQTCNPTFIDGRNAILSAEMLTTKGEDRCMIWKTFAKRGLGLNALAGNKMNISDQVEDFSIPKDCTDGNSNIAIDRSLVKIYPNPAKDEFFIYLKDYTIGNVHVQIYDMSGKLVLSENRSSPDSRIQVSTRDFESGVYVVKLQGIGIDISSKIIIKKHHHHHH

SEQ ID NO: 982 - protein, 654 aa, Artificial sequence
  Optimized for E. Coli
MGQRFNSVVFNKLPQDYQLYPRDGQSEGIVPISGVVEVTGYSYVSVQVFRNDTFVKYLKASLTYDNKGVGSFAMETRIKAELAQYSFKVFACKTIDSTLIVTRKNVVSGDVFIVDGQSNSTGFFDEASTDPYCRTFGKITDILNTTPYNPADTLWALSNQQKYLTGVGTMGFEIQKQLSQKYGIPNCLINGGFHWSSSVNHAQRTENNPADLNTGYGRMLYRVQKAGLQNAVKSFIYRQGESEAYHEGSDWPGNFKKIRNNLKLDFPKLEQIYVFQIDIIYFPSTTGAELREYQRRLPELYPDVQSLATVGTKQFDGLHYGPEGYRQNGLEVSRLIARDFYQLKDTVNINSPSLKMAFYTSQEQKQLILVFDEGQQLVYPEPYKVNDQLTLLMKDFIYLNGFPAGITTANADGNRIILDFANSQNASRFDYLPPYTLETNYFYPYNGPYLTNKLGMRAFTVNNFSIANGLNSSNLTSSVNPFANAVLSWTEVNGATGYTLERKLAGENDYTIAGKFSASSRSFEDKTSSFPGKISYRLKAGNSISESSAYAYAEVEIPVILGLEESGKDLFEVFPNPVVNRENVTIHFLTPVKGSILLINSLGQILKRQTVNRQPEADLFLQDLPSGTYFIQLQTEDKSLTKKLPVVRHHHHHH

SEQ ID NO: 983 - protein, 654 aa, Artificial sequence; identical to SEQ ID NO: 982
  Optimized for E. Coli

SEQ ID NO: 984 - protein, 988 aa, Artificial sequence
  Optimized for E. Coli
MGIEHPFSLLRNLARTGNDTHEHGDETLSFINAMEKLNIHSVFDIVRRSKSAFVHELSRISDAGAALAYENARCYATQIVRLYRNQLLSSGRTQQLTQRTGVRSLVDIGPGFPNLFKENWDLFCKVGAIEAKDSPVAYLTSLYRFALEQLEGSVAEPSRIKLDERRPDLKDLLIDHQSTFTPVPTLHIVNQVLSKAINAYVGTVPEDKGKTIYQLVAEKQHPFQFPYNFHFQQISLGLDGKKPTLGELSYRVSLEVPTTSRYGSDYGKVQHSSAIAQVLMSGAGPEQQAIVLEPALSSQANADTSADLTRQFFKTKYNVDYVDDASNPLNNLNAFLEKTGLDSDGVEALLAIGNHTAYASPNILSAGHTTDEDSPREASLTAIKARFGAGYVNGPTTQPAMALNKDAYGIKRLVNTSVDRFDRLQRMIRLQRWTGIPFTALDTLVMAVVRSEGAVNPQMVLTVNTLRALGTYRYLNKRYGLAPDEFAAFVHQMPGEANDGRLPMFDRVFNNPALFDTPLVLDGSTLYLDQHSSQHVKARAQLSRALHLSSTHEGLRQLAIDVRELIGNAPTDFRLNLSMISSLYRQARIASMFGLTTAECRALIDLLGSLSFRKKVVSGQLDDTEPDVLDILMQLDWAVTWLEASDRDVTTLRRQAGWDMTETIVTQELTVQLEQLTNDARLAVLKGDQLASLDLPSKDDQNNTLNWWAILYYHLIDGFGLVTTQPLDEEPAVSIRRTLHERLSSIAIAEPLASEVEARLATFVLNGYRNQHRLVEELLLTLTGLPPDRCEPVIRWAGSDVSKFLAALLWDNGVIETLSMLIRYSEVSQQLGLSARALRTFLINPRWLYAGSEGQFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANRHHHHHH

SEQ ID NO: 985 - protein, 933 aa, Artificial sequence
  Optimized for E. Coli
MGQTDSSSLLAQLIDHTRPPAPGRDDFKTALRRLNINSVLDIVRLSEGAFAEQLKKYNDDDAHTAYLKAQSAVAQLERLFSEQQVSSGRPSLRDKRGFSADTSATYQALFKENWEQFCASSSIAAVDSPVAYLRALYLFALQLEQNAKGENTIKLSDRRADLKALLIDQHSVAGQVPMLSIINQTLLHNIAGATDAYTLLSKTWYPFSLPYHYHHQQCRLGLSGDKPMLGELNYRISRQLPLKDGTNTYGQVIGQNNEVQCLLSGLSPEQQTLLKSDWVAAQDAPTFYSKYFNWTAEKGPENVTDFLHHTQLDAEQLQALLAQQTQAARKSPNYKQDTRFTYGACYINGANAPAAAIRQDKGGPAKLDNVSLERFDRLQRMIRLQRWLGLPFAQLDTLLVSAMRCEGASNRALLITHNTLRALGVFCYLSKRYNLQAEEFAAWLHQLPVHASGERVSLFDQVFNRTGSALPPLYLDGKVFDATTEQQLCAGLGLQDTQDSLHLLITDKPATRTIETVSALYRQVRIARLFGLSVMECQQLAQLLGKTNVLTQLRTPTLRRKPRGATDFLDVLMNLEWASRWLKENGNSLPLFKHQLLLDRQVQDPAINLLVKAFNAYDQASLATQLNLLELPQQPKDEENRLPIVDWNTLIPQVLQNARSSTSIEQALDEVLSSVAISTDSKRNTVIKDQTKPKLLTLLNKVRDELWALYLRLKDIIHAVPHLPGNANGHQKYEHHRHFLRLYAPAAPPLRTLSYLILLLPHAVDVLQLPLSRHALDQFIINPHWLDSDYQASALLELTPHTLYLMQQFKHCIDRLGMTEGQVLDYFRQANTPPDSVAQNNSEETNEHLARFCGWSAGEINVFSHQLKPPRITSMDRLEWLLRCRHVSTETGLSATQLIAASQLKSDSTFAQWQDVGEALISAHTSLHHHHHH

SEQ ID NO: 986 - protein, 932 aa, Artificial sequence
  Optimized for E. Coli
MVERSNALHQHTPALQLVDPRGLPVGSIALCRTSSDIEPQILTSHASFDMAGRPVSCWDSRLWADRAPANLSVIHSLSGQVLASDSVDAGWRVSLAGEAGQALVVWDARGVVRRIGYDALLRPIEVFEDEHCVERLLYGGPDSTDHNQCGQLIRHDDPAGTRLDDAYGLSGNVIRQTRRFLHSADEPDWPESLTGRDALLEPGDGATTCWQYNPLSEITWQRDAQGNVQCLGYTVAGQLKDSRLQLNGQAEQVLVSAIQYDAQGRVVSETAGNGVISTALYAAEDGRLGELNTTRSNGQSLQDLRYDYDPVGNVIRVDDRALPAISKGQRIDSVSTYRYDTLYQLIEASGREWAVVNHGPVLPGFQSPADPSTLADYTQTYRYDAGGNLQQLTHTGTQSHSRTLVTARFSNRSLPVINGHIPDEAEIAAAFDANGNLLALQAGQNLSWDRRNQLQHVRPVIRENGMDDSERYSYDASGQRLRKVRTTQAKTITHTADVRYLPGLEIRTDTATGETLHVVVAQAGRNNVRVLHWASGKPDALENDQTRYTLNDHLGSGTLELDGQAQRVSHERYYPFGGTSWWAGRNAIEASYKTVRYSGKERDATGLYYYGLRYYAPWLQRWINPDPAGLEDGLNLYGMLRNNPLTFIDAVGGVAEIPKHIHYIWLGAAEPLMEHLEGIKNTSVLNPDYQLTLHLHLDLRKGDETEIASALRGRRNVHISDLREEEFFRKFQKTPSYEIYKDLYGDDPRHYSAASDVLRYSLINHYGGIYSDTDDMFKRGVRDTDFITKPKRIFTMRPTDTPWNRDEIVINNNSFASPANNPVLSTLEKEIVDRYSVYRETGLGKVLSSTADVSDRMRIVSAVTGPKVFTEVLLKEGRGLRKLFSTMVNYHVKGEKLKNPKRYQAEAQKRMPLSNFIKMGGSHSWQHHHHHH

SEQ ID NO: 987 - protein, 446 aa, Artificial sequence
  Optimized for E. Coli
MGQHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVVEQQLQATAKAHPHDGGRHRNEPLASVYTLRSQLQISLGDMRDCWAYFDTARYPDAIQVRLDRELFSMLIGSYYDDRVPEPATVTLPVPPTGPIRSITLQGYVFVDGLTLSYAAGQGPDRVDAVHVGGAGGAFFSIDDIVERGHVRAVLVQHGYAVDRLGLEYGDGTLSGTVGNTGNQDPAARLAFPGHHLSSVIGFGTAAGYGGVLSGCMFGFQLDEPSAPVAFDRRVQDRLQRVWPSGLQAALRRSAQGHHHHHH

SEQ ID NO: 988 - protein, 446 aa, Artificial sequence; identical to SEQ ID NO: 987
  Optimized for E. Coli

SEQ ID NO: 989 - protein, 426 aa, Artificial sequence
  Optimized for E. Coli
MGQTENVLDIRTIVANEYAVKTSALEWDVTDIVKNAIIGGISFIPSVGPAISFLVGLFWPQSKENIWEGIVKQIERMIEESALKTIKGILAGDIAYIQERMATVADLLEKHPGSAEARNAFNNLAENIDGYHKKFNNFSDDVNYQILPMFSTTVMMQITYWVAGLERKEEIGLSDIDIEKVRGLVKKTVEQANSYINNIYDRELNDALNNSTADTVVNNVMSVHGHCRLHGIEYISIWDRLSETESVNNRIYVDVLSYSTFFDRQTAKARIQALTPEKDMTPPLKPALNGGKRRKINSLMGHIVRIGGAPRVGGLTVVFDDGSRHQLGTISGETASISLDSSRITSLEVWGNGAVDKAVFTLSDGRSLSFGEPGTSRYRKFYVGESHYISGIYLSSDYSPLVGQAANIAVSYQLINDDEKHHHHHH

SEQ ID NO: 990 - protein, 140 aa, Artificial sequence
  Optimized for E. Coli
MGSRITIFIDSDEQKSEVYSNSTVPVRKELNTVFPLSELTISPGSSVEVFRIDTPIIPESRRSLRVVNTGLASHVTAKFYWSHSFTSEWFESGSIDVGLGEDKVLNVPNNSFYYSKFVIYNNSDKVAYITANLVHHHHHH

SEQ ID NO: 991 - protein, 309 aa, Artificial sequence
  Optimized for E. Coli
MGSLQYLDKRLIGAIIVDAWQNHFNTEMDPADGQWFTNGPGNNGGLYGILTDTLASELKFLPDQQVFTMNKIAAATSTADNRNGLTPHQTVSLTYEYQNSTTVTHSTTNTITVGTGVEIKSSAEFLGTGAEVTVSFNTEYSYSWTEERSESVSETKTFGQEVSTDIPSGLVYQVTLLADKANIRVPFYADIILTGQSVANFASPVNGQKTWAIDAGTLCEWINQYGSAGNESYRYMKDASNPKQGFIRLEGNLTATQTLNFTALTSDITDSFTATAQPALMRELNNSELEKLESKAIKKVALGHHHHHH

SEQ ID NO: 992 - protein, 461 aa, Artificial sequence
  Optimized for E. Coli
MGQQPKVWSEYGIEGCIYYEDKYGYLSLKTDGNPSEHNWYFPSDGTSNNRWDFIQWRAGIFTDPKQWGDSGAKGDIYYSKEYLSFFILQKNGNPSEHNWYFPSDGTSNNRWDFIQWRAGIFTDPKQWGDSGAKGDIYYSKEYLSFFILQKNGNPSEHNWYFPTDGNDNAQWIVKGNIKKQEWIKYINDERPINQISLPGTHDSATYTIGSAAIVSSYAKTQDDSIFEQLESGIRFIDARCRHISDVFAMHNGNIYLNINFGTILNDCYRFLEQHPDEFILMSVKKEHTEENNTRSFDKTFEIKYYDSSRWFVEDRIPKLKEVRGKIVLLRRFSGGSLGVNAASWPDNQTFNTENKIHVQDEYNQHNEAKKWHAIKNAWDFGVDNSKKGWLVLNFTSIAADTFTSIRSYALDKNPEMAKYISGTKANGGVVISDFPKIGKIAENVIITNFGEVEKFHHHHHH

SEQ ID NO: 993 - protein, 380 aa, Artificial sequence
  Optimized for E. Coli
MGAAEKWQYDVIPDKSKNIINVTAKNITQNAANDLTYKVKVVPNSSIVGRTVLRRLFSRNVAAFATVAGIELTLKSLGYSLDYDSQTVYREIKTDSDIGWIDLNGIWHNDPNKWGKAWVDTYNSNGATPKAVFNRVELDEKNTAYLWVDRTYGAETYTSNVTSSASQPNPNPQPTPNVREILNPEAIGDIVLGNPPKPVNFSPELPLPSYPPVYSPELSNIFKPVPDVNYPNDLDPAPNQVIDLLDKSQPSSSDQIITTTPTPDGSSSLLPNFCDWATPICSFIDWFKDDSAIPEPEKYEVKEFDKSKLPTAPQFSFNGQCPAPKIFNLNLGLASTQISLPYDYFCSFATDVRPFVILAAWLHACFIFAGFVRSHHHHHH

SEQ ID NO: 994 - protein, 380 aa, Artificial sequence; identical to SEQ ID NO: 993
  Optimized for E. Coli

SEQ ID NO: 995 - protein, 1099 aa, Artificial sequence
  Optimized for E. Coli
MADMWVLDRYDNPLAILSSDAEDDACTFHSDQFLEKLNQGTEFSFSCDARHEDSLHVNKLNQVVFRDEDGFFRLFKIREIDRGNGDNGAEKIAHCEPAEMELLEAIVEDVRPTGKTQQYALDRVLEGTRWKGNVTAQTGTQSTNFYHISAYEAITKIIEVWGGELRFTVNFDEENNKIIERVVNIEQRRGNDEGDRFEVGYNVESITVTEMAYPVSALYGWGGSVETENGGDSRYIDFADVEWKVSNGDPADKPKGQKWIELPGAKEKYGYKKSDGAFINSFGQWQDENITDPKELLQKTYEHLRDTASKPQATYELKVIPTDHISLGDTRTAIDDTQADPIQIQSRVIALGYSISNPAGTKTVEMGEFLEIYQPDRRLDDLEDKVKNIDRNVQVTDGSFPDIIPKVPSNVTIKGLFSGTSITWDYDPSSYIAAYEVYGSQTTGFTPSIENRLWRGKQSGFLHENAGVDNVWYYRIRAVNYHGKASEFTAEFSAKTQRIMTDDILFGAVTADKLANLAVTADAISRNFEEANILPGSLLRLSDILRVDSRVIVNEVNGFNELSVTKDTTEYTSFGFTTGGRNSLKLTKGETYTLSFELKRETLNDFSYIQVRSKSGTQYNLTNNFTDLSSYPTDEFVRFDLPFVSPATLTDGRVCLGGRTQNLTDSANFTIRKVQIRRGNVRMSFGFSPYDTQLTDGAVTSAIIADAAITSAKVAEAAIGTAAIQNAAIARAHLQEAIIDTVHIADAAITSAKIKELSADLITSGTIKAINITGSLIRGGKFQALNTNSNFDSYFDGDKLYQYKMNSKSQYTKLDISSSLIYQEAGADYSIDGSKPEIWRSVSIGNGKVSVKGSGEFTNASNMAVVEMYGDFNGDGDGIGKFVIRNETNTTVPSDIFTLEGGYDPIDVNDRYNANYTNRATITGSSTLLSLQPLNFETVVNGGIRMKSSKRTVFEGAPVELPKKSTIMPGDDQFTTQEKIVGGNVTSLVTDIHGALQNNLMICITQIDVTLGASGGAYAYAYNWYNMVDGNYQGAENIFAVMATPYGKNANNVTVGIMSQSSEKFAVHVRGTGATDVAATTVTIRLAIFYEKKHHHHHH

SEQ ID NO: 996 - protein, 963 aa, Artificial sequence
  Optimized for E. Coli
MGSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDMLTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPDPKWIAESDNEQGGYYQDSFVPTYRMILRFVPRHHHHHH

SEQ ID NO: 997 - protein, 963 aa, Artificial sequence; identical to SEQ ID NO: 996
  Optimized for E. Coli

SEQ ID NO: 998 - protein, 979 aa, Artificial sequence
  Optimized for E. Coli
MGIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPENHHHHHH

SEQ ID NO: 999 - protein, 979 aa, Artificial sequence; identical to SEQ ID NO: 998
  Optimized for E. Coli

SEQ ID NO: 1000 - protein, 190 aa, Artificial sequence
  Optimized for E. Coli
MAVYFVTGKLGSGKTLSAVYKIRDYLMKGRKVATNLNISFTGMFGYRAKNINLVRVPDKPTAFDLDAIGRGNTSYNEDLNGLLVLDECGTWFNSRSWADKSRQDLINWIAHARKLGWDVLFLVQSLQVVDKQSRLMFAEHVVYCRRMDRLKIPYIHWILQIITLGQFRLPKIHLAIVKYGDSPPHHHHHH

SEQ ID NO: 1001 - protein, 930 aa, Artificial sequence
  Optimized for E. Coli
MGQTDNSPLLAQLIDHSRPPAPGRDDFKTALRRLNIHSILDIVRLSEEAFTEQLKKYNDDDAHTVYLKAQNAATQLETLFREQQVSPPASSPRNKRSIPPKTSAIYQALFQEKWDQFCSSSSIAAVDSPIAYLRALYLFALQLEENTKDTRALKLSQRRPELKDLVLNQHSVSGQAPMLSIVNQILLKNIAQAKEEDTYKVLSETWYPFSLPYHFHHQQCQQGLSGDKPALGELNYRISRQLPLAEETSSYGQVGEQNNEVQCQLSGLSPQQQTLLKSSWVTETGAKAFYHNYYNWKSDLIGPAKLTDFLSHTQLDADQLQALLALQTQSPRQSPNCKQKTSLSYGACYINGTTTPAISLDNAKLTNISLERFDRLQRMIRLQRWLGLPFAQLDTLIVSAMRCEGNRNNTLLITHNTLRALGVFCYLSKRYTLQAEEFAAWLHQLPVHASGDRVSLFDQVFNRTGSALPPLYLDSARFDDTTRQQLCAGLGLQDTQDSLQLLINPNKPATRTIETVSEIYRQARIARLFGVSVVECRQLVQMLGNANLLMQLRNPTLRNKPKGMTDFLDVLMQLEWASRWFKENGSSLALLRCQLLLDRQVQDPVINQLLKEFALYDQASLSKALQPLDLPQQPIDEKDRLPAVDWEALAYTALQQMRPSNNIETALDHVLSSVQISTAPARTTQLINQAKSKLHTLLSTVRDELWSLYLRLKAIIQAVPQAPSDANGYQKYDNDQHFLRLYAPAAAPLQTLSYLILLLPHAADILQLPLSSQALHQFLVNPHWLARKYKMPSLLELTPYNLYLMQQFKHCIHHCGLTEEQLLNYFEHANALPNSTAQNTSEDTNEHLAQLLGWSASEIDVFSNQLKPPRITSMNRLDWVLRCRRASIDTGLPANMLIKASELKADSAFADWKSVGEAITSAYPHHHHHH

SEQ ID NO: 1002 - protein, 809 aa, Artificial sequence
  Optimized for E. Coli
MGRNASERTDILSESELLAWLRVKPRTLEWDALLVYDRTRANRLLLQEYIRRLHSESFLPPITRLINHVPGAHWEYIADQLLAAPRLSFEDSTITSSMANLTMHVMGGTQWSIQKQPNGPRRIVKIEVIDTLQGPKLTGHVFLSEVEGSVTEDGKVQINLHEAVDLQFTYADTTIMREQAGDYFQRLFEHLPEEQQVFVLNELGPVDENDFLDPHTFMFRIFRAKDAQYRDSPTWGEGAILAFINGKGNQSNQGPISDVGWVYPIPEGQSVTLLVSNRFLIRNLLESGIRDMADGNVIIEVENPDNPSAPAGTMRAGGFRKQDLLQSVPDDYGEDPFFDSVRYTATFPLNSQGSPPGEFVVRHENERIIMEWSGSTVNSTPQRMPTLDLQWQGKSCRITLLAEWHFKRAYVFTAGQYGARLEVDRAQSIDEAKVTPLTVSPEYGNEVMDHWLPLAQFTTISLLLNSFDKVALPTREIDLFRLHSLLFQSEHSLVLESGHYPTDLAMFGQLSPQETYFAVEPQESLMAPGAKQQMTGVDGAVWKVKGVPGFDDGAGSITPTGLYTAPAASEIAGHHTIVVVTATHGRQTSSALVRVLKRSVVCNPQVVVVGMGGQQVKFSAGSLAEGALTWALKSDSGATLKEIPLDNDVPFEPGDHFYTSGPAPQRHADLLPDNFIGIDEVIVTHDASKATTTSYVLTLLLDGMAEVRVIPGSMTATQVKLEMRTSDPEPIPEPDWDVVLGGGSVDADGQYTADLAAALPFAVVRGFKDYGFPGVPQFCGYILLSVPLVDLEALKEHDWDTDTHHHHHH

SEQ ID NO: 1003 - protein, 584 aa, Artificial sequence
  Optimized for E. Coli
MATANDIKLTGNPEIDQFFSGGIRLLPTEGNTYYWHMPNEVHSSVTTVEPITNELAKNMVREALQQISNVININFQEVNYSVSNTGGFDILSGTDLYPMEGGISLNSEQSDATIQFLNNYSDTNTSISSKARTITMHEVLHLLGFDDGPISRNPDYTTVDSVMSYNSLIDDRYGEKVRSYVYDENGSQMDGTSWATTDTLGIYDIQAIQSIYGANYNYNAGNTVYKYTPETLKNFQTIWDGGGIDTIDASEFILGVELNLNDGTRSNLFIKDYSWNGYEYDGTRAIGIAYGANIENAIGGQGNDVIYGNELNNVISGNDGNDILYGADGDDTLDGGSGTNTLYGGSGNDRLISKGSDTLYGGDGNDRYEISGTDFRIIEEQNGGFDTIDIYSFDAATYVMPEHVENIRLNTGWDINSNLTGNDLDNSIHGNFGNNILIGGKGNDSLVGYRGSDTYIFSKGDGRDTIDEYNNNNVPATDTDILLFNDISIDQLWFSKYSSWGDESLLINVLGTTDQVTVYGWYTNNAKLEQIKTQDGVTLSIDQIESLVDIMANQTMPLANNSTIIDDYLMVQTSMIMGHHHHHH

SEQ ID NO: 1004 - protein, 497 aa, Artificial sequence
  Optimized for E. Coli
MDTKNDNTVQGIPVKRKMKIPLDSAVPSGYPIPKLKAQLTDLGLTCEETSEEQLQQYKDDVMKDFKTGSRTIYGLYRGKPKANFYTSDLLGADGRFRVNGNEFMNALGYTKLAENGSWTLDDDAEGYRAELCTIIYEDNFEFLKTDYPFDFNGQKNSQSQTINEPTGKAIESTFSSMAKAVVGVVQSGISSDDLETLVSTIIDKNQSSNIHDYEMNDVLIAYLVNDYDPVKQEAVAVGALSISYYIHIKDYKDKGDNKDGRYNDAIIQVTARFVSYSDLEYMERDLKRIETRTKALFEVQEQSRYLVKGNCFTLLDSSGGIPPKTTKLVVYDKKPAANATTFLTGLPLLNKGNYADVMIFFCPDLVNVGCLDNTDSDVTSSYSKSVTIGFQQTEGISISTETSMELSIEIVKVGFKLGVSMTMSNTWSKSETETVGYQLPGRKMAYLYQGQMESIILRYDPSKQAYEYVNSSLNKFLTNAVKTTEKPIILEHHHHHH

SEQ ID NO: 1005 - protein, 379 aa, Artificial sequence
  Optimized for E. Coli
MGNNQLKDSCLQTATAGLVVQTYCNQVAIQPAFNLPDSVKTKMPDVDAYLTAAQTNANHYLRNVQPRIIAVIADVGGYSSEFGSFYGLIDQKIQQWKTGSDDGKKDALLLLNQLEVDLQGKLSNVKGVQSDINSFQTMVNLDTSHFNEAFQSAQVIIGGNQGAIAAYNEQIGSLNKQIAGASAGVGLSGLSIIGGGILVCVGVFASSVTGGLATGLVVGGAALVVVGAGGLVASSIALVNLINAKANLIQQKVALEQNLQALTTFKSSISDLKDSAASAAQQLTNMHNAWSFLGRNLGEVVTSVRNAQTYSELPIVVQAYLNTAASQWEDVKGSVKTIERQMTGVSTSTLKDGKGNPAQLTKQSIINYVSHAAHHHHHH

SEQ ID NO: 1006 - protein, 379 aa, Artificial sequence; identical to SEQ ID NO: 1005
  Optimized for E. Coli

SEQ ID NO: 1007 - protein, 448 aa, Artificial sequence
  Optimized for E. Coli
MGSQCSGEPLAQNMLCAPDEGIVPDTGADLSAQIPALLEKSSAEKKGIFFPAGEYLFSQDVVMTSWNTLQGSTQGTVFRGISPTGSAILVGDETYTNTVTDLTVSHIIFDNARVGFYGRKNRINLAYNAFVNTRTATNTGQLTASTNPYLIRGNIFMRGNGYPGVGLNTYGNAPGLIIEHNFLGSPDKMSKAAPWLLDDTKALLETMLTLREQGKLAFDDTQDKFVAGWYSTSNLRDGTFRNNFFSGSTNSKLYNPDTGAEDITRDHAVYIKQYDKVVVTQNYFGGWPEDASGQLKFRNANGLVFAANYLDNISFNARPYDNTEPAWWIMTNTFIFNNYVKNGIINYWQNFYDTADKFITVTDYLVFSNVFDVENKNDCLVSGQSISLSEEFYESNNRFSDGTDGVVTCGVMNPLSLDDITARLPDYASELLNLQPLKPGADHHHHHH

SEQ ID NO: 1008 - protein, 448 aa, Artificial sequence; identical to SEQ ID NO: 1007
  Optimized for E. Coli

SEQ ID NO: 1009 - protein, 272 aa, Artificial sequence
  Optimized for E. Coli
MGLVSMEKYPADSILKDYPLGIYDNIGINLVKKWERALVSFHVRKPFHRFEVETVGTGFLFENESVVGIYTASHVIKQIMDDKTRTIRINDSFYLLSNVNVFYEDTQDYAIVELPKEAMNGQRIVAFPLAQRNNLNLTKSFMIFGYPANKNVLRLGKQHLFNTLNIFRNDFKYDTETEDIFFEFNKKDKYIYEPDSSFKSLPALNGMSGSPIVQIVVNKNTEALTLRVIGIFKIHRHNNKEKYLIGSTLTNFADEINTMISLGVLTHHHHHH

SEQ ID NO: 1010 - protein, 1275 aa, Artificial sequence
  Optimized for E. Coli
MAIVDFYGNSVRLGSGVSRVVNKSALVGGVATGTAAAEAFNINGAFTLAGGAGDDRYYSVSRDSKIVEKAGEGIDTVYVISNYVMPGHIENLEIGYASGVIGNGLANYIKGSLLSQSIDGGAGNDILTGGGGGDAFVFRAGSGYDMITDFHTGPTADVRIAPETVRLAGYEQFSSFAQIKAAMTQVGSDVVLRLDADNAIKFAGTTVSAFTKDNFELRFDSTQLKASFSDDFNALSLWDGLAGGTWRSDYGWGGDRNATMARTLAGTGEKQLYVDSGLLSKETGQAMGLDPFSVKNGVLTIHAAPTAADLVDDLSGYKYTSGLLSTRNSFTQTYGYFEARMEVPAGKGVWPAFWLYTTGSSGSELDVMESHGGDQYGVTTHDLSTGTDVPLTGTVFVPDLSEGFHTYGVMWTSETVTWYLDGVAVRTIPTPPDMHGPMYMLVNLAIDANVQSDFVGADMQVDYVRAYTLEAAPAAVDRTAGNMISGNTVSGGGAIDYLSGTTGADKLVGVAGNDTYYVDHAGDRIVENANEGLDTVRTGIDWALGANLENLTMVGSAIRGTGNELNNVISGNALNNILSGGAGNDTIDGFAGADRMIGGTGNDIYVVDNVGDVVVELANEGVDVVTASVDYSLSANVENLTLTGTAIRATGNDVANILTGNELDNILAGGAGSDRLDGGKGADAMSGGRDGDTYIVDNVRDVVIEKANEGWDSIVSSVDYTLSANVEQLTLSGKAIRGTAGSAAAFLYGNELGNVLTGGAGADTIDGKAGNDRIIGGAGKDKLTGGAGADTFVFGANFGADTITDFRIGEDSIDWSALVPIYGAPKITNVGRNVVATFGTKANSITFTGLDAANLVAGHVFDALNPLGNPFPEPTDEPTDEPSAPVAPPVINYPTLTGTSGDDTHIVSVADTRIVEQVNGGIDTVMSSLDYILSANVENLRLTGSAISATGNELGNMLSGNTLDNILIGGAGHDQLIGLEGADIMRGGTGNDSYSVDNVGDSVAELANEGTDSVNSSADYTLTAHIENLALLGLAVRGTGNDLNNVITGNLQDNILSGGGGNDRLDGRLGADTMAGGTGDDSYIVDNARDLVAEAPGQGWDMIWSSVDYKTTANIEQLVLTGNAIRGTANATGSMVIGNELNNILTGGIGNDMLDGKAGNDTISGGGGNDRIIGGVGNDRMTGGGGLDTYLFASDFGKDVITDFDVRKDKIDLSVISALYRPTISEDNHNAVLHFDTNTITLLGVSVDDAQQNQFDWLSISLASPYDMAHHHHHH

SEQ ID NO: 1011 - protein, 592 aa, Artificial sequence
  Optimized for E. Coli
MGNGKVYVGQVDTDPTIPSNQIQVYIENEDGSKVPVSQPLIINAAGFIVYGGQIVKIVADSNYSMAVYDAYGTQEFYFPDLLKYNPDQFIPELADPDSTVIIAGTEASKISYAATITANMNTVQELIAAHVPDNIGIVITAGYYDVFGKRDVWVRSTEMDLPSKTPIQLNKLSVTDANGSVWNLDISSGYIYIDSIGAKGDGTTDDWYHLELCFKNAEQGTNRIVKGNKSAYFFSKPILLKTGRHLEFNAKFGVDITYGGQLLSSTDAPSATTPIGSGFTSTFSDKQAQIVVAHKDGQFARYWSVKNCYIKNDSGTSSTFGIYCPFGNAFDLEHVWSIGGLTGFDARNIYTYSFSGCYFAAPVGITGTVGINVTPIQNGLGSGTSGTYERVGIVGYKYSWIFTEMNYTTLTSCYSEDTRTRYALFLTRCNGININTYGIENLTVVSGDGRLAAIADSQISINALQASYNINLSGVSAITVTGNSQVTINDVFIVAVGSPYVPLQTDNTSRVRMFGFKSTGPTPLVNITGLQTVIYGDQGRTECAKFPGNWNGGFLRIGDVRLWDDGTGLRIKRGTDPANVSDGTALHHHHHH

SEQ ID NO: 1012 - protein, 592 aa, Artificial sequence; identical to SEQ ID NO: 1011
  Optimized for E. Coli

SEQ ID NO: 1013 - protein, 178 aa, Artificial sequence
  Optimized for E. Coli
MGSLTPGVICMFTGGTIPDGWLLCDGKNNTPNLIDRFILGASSADTNIISETGISGSHPKKYFTNTTNGSLITASVTIAPHTLTIAEVPSHTHKIVDYEGDYLRNADGGSRSGSDRYPVSTGTKQPDLTTTSVGGGGSHSHNGSLTNQSSHSHGININMPYYTLAFIMYVGVHHHHHH

SEQ ID NO: 1014 - protein, 127 aa, Artificial sequence
  Optimized for E. Coli
MGYSTALNPNNSLEKQCEKEGGGSYFIKNAHITFMNATVMWNPENSAGDWKVHNAINIKLKYNVENSTKEAWFGVFGENVARGSSAFGLSSFAQAMFLLKAPVDVCVKGKYLRGIENNTASHHHHHH

SEQ ID NO: 1015 - protein, 127 aa, Artificial sequence; identical to SEQ ID NO: 1014
  Optimized for E. Coli

SEQ ID NO: 1016 - protein, 414 aa, Artificial sequence
  Optimized for E. Coli
METKQDNIDISSALRKIGAHSKLTQTFIDGALASPNVQLEEVPSLNTTQFLIKQDMKEWSSELYPKLILLNSKSKGFVTKFNSYYPTLKGFIDNGEDKEGVTDRLEVLQDMTITNQESVQRQINELTDLKLQVDKKLKNLDTDVIKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDGEIELMKHYKEDLGLINNSITKLSTEVDANNTQSQKDTLRRLKSVTTQLEEQVYKFHHHHHH

SEQ ID NO: 1017 - protein, 414 aa, Artificial sequence; identical to SEQ ID NO: 1016
  Optimized for E. Coli

SEQ ID NO: 1018 - protein, 387 aa, Artificial sequence
  Optimized for E. Coli
MGQEQTAQEHKIENYALGPDGLKKALAETGSHILVMDLYAKTMIKQPNVNLSNIDLGSGGGELIKNIHLNQELSRINANYWLDTAKPNIQKTARNIVNYDEQFQNYYDTLVDTVKKKDKVSLKEGIGDLIDTIHTNSNDVTEVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWNDIHKDAEFISKDIAFKQEKTNHHHHHH

SEQ ID NO: 1019 - protein, 387 aa, Artificial sequence; identical to SEQ ID NO: 1018
  Optimized for E. Coli

SEQ ID NO: 1020 - protein, 354 aa, Artificial sequence
  Optimized for E. Coli
MGSESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQVRHFKQVESDGIITVSVPSIPTWIAGGVMIGVARDNLGTLEPLLAQLRQTIDYKITLNRVVGVAYNNIAEMQNAIGLAINALTYMSAQWHDLDSQYSGVLNHIEKASQKADQNKFKFLKPNLNAGKDSWKTLRADAFTLKEGIKTLKMDPVSSKKHHHHHH

SEQ ID NO: 1021 - protein, 354 aa, Artificial sequence; identical to SEQ ID NO: 1020
  Optimized for E. Coli

SEQ ID NO: 1022 - protein, 217 aa, Artificial sequence
  Optimized for E. Coli
MGYLMGIDGTMGTGKTLCMSVLAQHFRQQSGCTLYSNYELKHSKLITNFEMFLDVAQQPSSIICLDEAHTDLDSRSVNTNVAKYLTHMVFYLRKLRCTLMFTSPDIANIDIRLRLIMNVYCKAKKNKNYFNYSLWNAQDNKPLRSLRVNQRKIFAIGHQIYDTNGMVVPMDFPQTKEGYLDILNLLKKVSNQYYAQASSDAGQQATGADAVHHHHHH

SEQ ID NO: 1023 - protein, 317 aa, Artificial sequence
  Optimized for E. Coli
MGFKNDIREKAVKFGKSKTSDQGLLDALHLELPDVKAVMSAYKRQLPEFDDFNRKTQLILNASKEFGQLKPAKQRKFSKPGLKESGVSGGNFIYSKKSLQDFAAHAGYVHNDHYGDEFVNLKDNNRNLADERLFPGISLIKRPKLSIVKDQEQWNMQQSDEAEAYKITDIEAFISGIREMYGEVNPLHPVIESLIRNHIVNNHYILPTMAGIAGLHAEVQALNNLLTLEDERAGKAIGSRKMGEYMRDILKSSIFTQRLTTKQAGDDFAACHNCSGILSSPVNVITGKVESAGSNFSSTLSRYKTSQESPIHHHHHH

SEQ ID NO: 1024 - protein, 366 aa, Artificial sequence
  Optimized for E. Coli
MGILKNENGITDGNSVVTAHTDDKASAQWVNVTDVCVNVVSVSGQAPLLYANGLNMIAVRVYMTSQDINEKTIDDIDVNELVGAVTLIDYDTGVPFTKIDHPPSLNHITPGGTYCTVANKYLSGSNFINPGISGYGKRYITLYFAYNGTSSTSVRIGCKIKPTYPDKGADGRYVYNEVVNSINGDTHCPTTPIKVTVKKFKDSDVTESHLYSANVSTGKSPNRDIFRYYIKFSDGVITHVDLPTSSQPGAPTGYFHYKQTGNYKDFCCFTDDKFDVDPSAKWTTPTFKIDNSWSDSVTFYNHEEDGVCIFLYRFWYGALWSYQEWNLGAIFTLYDEYGNACKISAIRDEPNDKIKFSVVNHHHHHH

SEQ ID NO: 1025 - protein, 1661 aa, Artificial sequence
  Optimized for E. Coli
MGNRDNDSNFFTQAGSFTSAISGGVDPRTGLYNLSITLGHINGNNQMGPQFPITLSYSPQSQGNMGFGTGVSLGVSTYDTSSGRLSLSTGEQYQTDENTSSVTVKQKKLDNFKFEKHGGESYRVTHKTGDVEILRGEDYGSSLKLPVRMINAAGHSLSLATDNNNRLISVSDESSPLLWVAYDDRVTLTFYPGTQEKYSVILQTNNDLLTTITRRTTGEPDLVWHIQYEDTGFWGQWATAMTSPSGLQDTVIYRCDGYTHRFPDSAPQSLRNNPMPYVTKRTLAPGAGQPIQVSVYSYSDYNYLGYDSGVDWEATQDNLYNCLDNYIYSSVETQGVGIASKTITREYNSYHLQVSEETSSGSNSVLKTTEYYAKLGTPFENQPEQFQLPRTITTMWSEGSTGLKRTETVITAFNESGNPVSQTDADGTVTQWEYYPANGSDTDCPPEPNGFTRFMKSETVTPRKTAYSTPAHKTAYTYATFEHASTDVSALVMKATEKHFADDVLLKTISCQYGTKAANTAGVMTKKTTTYPDPTDNKREYTTTETVDFTDPGVNGNNIDAWVSAYTLTSHDGLTVTRSRTVSCMTGRLLESTDNKGNVTAYTYNSLGWLTKRVHVKDTAYEHTTTYEYTVDATSGVFYATTTDPSGNKVRHGLDGMGRLLHIKKNDVDMDSKNSEPEFLMQQQTRDALGRSLTGSTHDYQQAANKNNPTQTVTQTQRYDNWGLVSESVSSEGVTTYTETVLVLPPTGTNCIWQLRSWQSGGTDTSGITVTTLDDNHNSVKTELYPKNAQVGKNTPYSVTYSEYDGWNQLRSQTDELGQTTTYKYDDWGRPTITTLPDNTQTHRAYVAFSSAKLPVSISVLDSNNIPVPGVGGTQTFDGLGRLKSTIIGGRHARYSYQFAYQRHPTVIYNEAGNQEVYTYINALGEAPESLRASGVDINVSQDWTYNPVTAAMMTATEDKDTENQHSLRYGYATSGQQTSVTVEKEGDIKEKSTNLMARTIGGTATTVRDYAGGTQTLTLDILGRATALDDADVSSTLTYDGLGQVTQWTVTSKKNHYTKTTTLTLDEYGRETQRTIETWDARNTLKDTLTVVQVWSKKHQVTHRTTTQTTAGKTVTLRDESYDFAPERGWLMRYTVSGSTPPQDETGKALSRQDFTYDSVTSNMTTKSVTYTDDTTTFTMYLFENKDDQCQLTGIRTDTGTTTSLKYDDAGRLTQDEYGRMLSYDALGRLCKVTLNGSTLTRYRYDAGNQLSGQTVGDTTTRYYYGNSTLAYMEDDATPKNAALLTPHAQVRTGKNAGIWLTSSDMAESVLSVTDGTTQENYAYTPYGARNGASSNDEAIAVTGYNGERLDGTLNQYHLGNGYRAYNPVLQRFTCPDSLSPFGDGGINPYIYCEGDPVNRTDPTGHLFTEIALAARAAWKAIRDSVLVRKVTDAAGGIWHNGKTMTDSLFGKRPPKNSLGRSFRDGDTAAGSRKEPRLQKEVDYKVTEASRSPMFKFNDNIRKNPEQLWSLHEDNGKYIYNSHTKVNGYGVEKAYVNLKKISNKPIDIISGSHGGNLGEGNWVEIFGPNAKREGVIRNPSYLEHKFLMQDLATLKKNKGLTDRVYNIKNLDRNELNNILRNPNTNVILGYCYSANDNYMASVDNRISSLIFGWRHHHHHH

SEQ ID NO: 1026 - protein, 883 aa, Artificial sequence
  Optimized for E. Coli
MGGITPDNPKTQVHNNGNVPVVNIAAPNNAGISHNTYKEFNTGIQGAILNNATQAVKSQLAGQISANANLHGKAAELIINEVTGSSRSELLGQLEVAGQKANVMIANPNGITCDGCGFINTSGAIITTGKPQFDTQGALEALKVTKGQITIGGKGLNGQSTDYVDIISRATELNGKIQAKNLAFTQGANQISFKDGTAKTIAGEGNRPQLAVDTKALGGMYANKIRLVATENGVGVNLKNITSHQQDITLSANGKMELGNIKAKTDLNAGAKEINIGPNSPVQAERDIVLASSKLSNKSSVTAGQDMRIYGDTISNAGAQALLQANKNMWIQKNAEGGKNELVENKSGTIKTNSGDLIIRTQNLVNEKENVQVTKTNHQINSNAGYGDYPKFKFDFNKPILIDSRHKDIKLEHADFVSNVDSKQAVIESGHDAYLYGETLTNKNSSISAKNNLILTGTHLKNSGVSFGLLEKYKEYFRSENRENILNRDILIWKNNSVSQSILSAKNSLVADFKESISIKNELPSEANNINQVIYGNNYAALNAKNILLHAKDVYLSNEIKADKDVSIIADNAVKTSLAVLNAGENISIAARYDINLLDSNLKSKNISLISHDGNVNVKNSLRAFYPDNTRLLSKLDASADLSISTGKDIYIKDTLFVSKSKNIAFNANKDITIEHTDDLLNHHNPIQQLSTDQEAKLFDSLSPTAKLDSSGSILINSGGNLSLNRVNLDADKDIDLYAGYNFNQYSKEFEPNHFSVSTVTKALKLQTHIRSGNNLLINAQHDITLEGSDISTQGSTNLLAGNSINLLGIPYFFENNGVEVLKYALPVIAIPPNKNIITTIKANKDINLISGAYYHPSRSPNNIHQDHLIPFNEIAQHHHHHH

SEQ ID NO: 1027 - protein, 883 aa, Artificial sequence; identical to SEQ ID NO: 1026
  Optimized for E. Coli

SEQ ID NO: 1028 - protein, 495 aa, Artificial sequence
  Optimized for E. Coli
MGMSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGKHHHHHH

SEQ ID NO: 1029 - protein, 479 aa, Artificial sequence
  Optimized for E. Coli
MGQGSVSSTSLQVSADSSDYYIIGSDFYNHFVRPTTVDLAKNKVVYNKQILTVYNGRIDKWKMSFLNQDSSGKSWFKFLSYPEATKGDIKITYTTDGINYSDSKPSLEQLKGYMVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKEHHHHHH

SEQ ID NO: 1030 - protein, 479 aa, Artificial sequence; identical to SEQ ID NO: 1029
  Optimized for E. Coli

SEQ ID NO: 1031 - protein, 102 aa, Artificial sequence
  Optimized for E. Coli
MGRYDDYHEAWEMNPRKLSTEEIENPGKVIEDFFRVSHLPGMRSSLWELMKTMVTGTFSNLKSRERARLIYFYEQVEKLIEAAHVLHEKNKGLSPSHHHHHH

SEQ ID NO: 1032 - protein, 1388 aa, Artificial sequence
  Optimized for E. Coli
MGPYNNASSGFGRSSLVQSILDIYLAVEQTERWKQAVKTVGQEKKLDSNWMPVIQNVKSIGGGKYSVQFINKQNPDNNPQWIETNDATFDNFKVFFNDQAKDLGAFFQVDSVTGTVSTQIEGGTVSAGVGIGSNKADLVKAVVEWVSSGELYDKSGNPDLDTAVGVQSYLNLAQYGHGIATEAAEVISAIRPALSNGGAVAREVSESLVSTVVKTTATEGLGIAMNIVNVVLDGIVLANTSSSVERASVTTTLVFDVVGTASSLLALGLGIAGASTAASILGAIALPIAGLAAGIPTLVALYAQRSENARKAAEPFGIIADGYKANADGTRGMIYQAADQYQKIPSALKPKGGAVITEIDLVNKKLKFGSQYLYQVNPDHKGAGHTKVNNRDSFFAGPDIGRASAKAKQLPRLSIRQGLGCPETMDLKYSDVEVIVLPRDIEMTFDYEHAIVAPLWQENESSPGINALRQIESHPDIYEKFYYDYWATSDYAISQFYPEYKATTVTVKLDKAKRSVVIPQVADIERSNLTYRLQGNGGTYIVALSEQEIDIRIQASDNPDERWIFNIDAIGLRTYSTWLRYPDCWTVTFHDDGFTIGQTRTEDKSLQITAAQPQRVKFEGKMPNYVVLSDNIGHIFIVNLKERNMSLMLNITKIQQTDSNKIGSMDMNSDSLLYRAYVSYRYLKQAAQSGNANAQVETGILKSVPLTNADNIAIVFEEPDSRLHYMGICDLKNFALVAHCKDQTRDNPPQTITQMQVDRYGELSTMRDRDRPDKLAFKGSFENVWTANNEIFFTQKIPQQESGTNSVIQYCMYRGEGFCFIDAINANARLMDQILAVPLSELRTSKVDRLLDQAGLILQMQPRPEVNRVDYVYGKDTYTIVGQNSQGVSYQIKVHKDAEPSLSWEEGEIQYQILSGYALQLTGTSANNTIALTPLSKYPNLKRAILFGQEGTDTYYVDRAILHYQAIFVLNYAKDTNQDVLRLRGFRTSDFSYIQQGEDIILTHKQSGNWLNLVGVSSSNPTANRYQHLQLQFDDVTFAVTEVASRLSLGTADVTTIFMNLEDITFEKQEDNLIVSQNNKTDSTAYSNFYTTYTSLNGFQVKFPSTTTGNMLSLNAQELAALGKYNVKGQTVVTAGSAKQFVDRMLAEIGNVTIYEVSSGNVSRQGQDLVINGQVCNKFFERPTQSRQIKIPYLLNDGAFIQAGYDLVFMRVKYDHNWGMDLWTYTGETSPACRLSYFYDSYIEPNPNQGYVTGRLVQTFTELNNNPYRWGTTHQLQVEKGNLNNLLEQMSVQIPTQDGKTVILSYDALKKLGQESAKVLASSTSYDQRSNTFTFGSYSNTDALIGFRISLYFDPQTNEVVADKQVDKYTRNSYLRVPAVIIHHHHHH

SEQ ID NO: 1033 - protein, 299 aa, Artificial sequence
  Optimized for E. Coli
MGTVAGDRLTNFPDSEWVGQRESISWQWQSREGLPYLTCSLLDRWSHGFFTRDFSPRGPIDLTEVLAPGAKVYRLQQVHGNAVLKTTELSPVVAPDSETAAPSYAEADGLVAGRELEALWVCSADCVPVLIADDRTGLVAAVHAGWRGTAAKILPEAIAQLVAQGSQLENLKIAMGPAIAGKVYQVSVEVAAELGATIAPKSAVSATADGICEFLHQLPETPVLADPEPGKVRFDVRLCNALQLQQLGIDLSQVAIAPFCTYSDSARFFSYRRDRLKKVQWSGIVSAGGTSSLHHHHHH

SEQ ID NO: 1034 - protein, 470 aa, Artificial sequence
  Optimized for E. Coli
MGQPWSPTPHTVNLSGMSEEYYFIISKAHDPSGQPLVLSANSDAHNTRVIVAVQSYQDDKQLWAKRLRSSGDTNTFALVNKARGTILARESANNGAAIVLVSIGNIQTNDLAVWQHDNVADQYNALCSVENWEQKLNIPGNGPYRAGTGVISHWWDRGSINELFRFFSASRALKLKRIVWDMHNGSFEELTPVVALQKTLHNNSNAEQQTTLEYSGEKSKTTKYGVEHGVEVGLSFTISAEVPSVAKMSLTLSTKYNHKVTFNKEETEKETIKLSFPVKVAKNTQMTAKVIMLHAKMDIPFNAVFDMAFEDGTSVEVVEPGVFSEVSCYDIIASYDESTTTTGGGIAPVGQDNWRWCRKCQGLFFAGHAHACPAGDDHDPKGSSNYVLQSTANTKEGQDNWRWCRKCGGMFFAGNGEPAGKQFGWAWCSKCQGLHFTGSGAGVCPAGGGHLHAGSSDYGLKFLSHHHHHH

SEQ ID NO: 1035 - protein, 1249 aa, Artificial sequence
  Optimized for E. Coli
MAKVFHLDSVSHDTGVVITDLGLQANEHDVETLDFRAGDETPIDPQHRQRQAQLEVVDKLYGPLHIGSVTVTRSALDALGAITDGQPLNGDNTFFRSPHRVFVDTLQFNPVDIQACINRTVDANDYRLPTLLFEIASQRPPTARPLLREIPDIPAEPGDYRGSLERLLNAAQKLNTSVLTQRTLSWVNKTKSNLLIPTGLGLQAFGIYSGLRGLQDAIRNKDTYQTAFNGASVTAELASIGLEAAITRQAMQMLKAGQSALGSFAKTSFALRLGRASGLIASVLTLPFDIIAAVDSLKAAANGRDATDHYVNAALSMTSAAMTVTIGVAALAGFTSAGPVGLAAGLILAVGSQIWGAIREVDEIDDYIELTVHERLRTGWFAFWMISPDDDIQQRYTTAKTTAEHTRQLRATALKLLQGTLRDSTEAIVNGKFNVELEAVTYNTWNWWTGERYQATRVRPTIKDSDDTIDARDGVTVDTPGAVLGTSAEHKGIHWHIGGGNDTISGVEKKPNVFHYGAGVKKLTGGEKDDVFIFEGSPQTLRTNPPLPPNRLVGGKGNDTIILSGRTKGPQEQLGYHVDLEAGHLSIIIQEQAKVHYPHAVLESIEHVEIQEGRTNVIRGTAGSNIIKSRGNDSIEAGAGDDQIFLLGADNRDADGGPGNDVYAIAHKPGSVSISEDGIDNSVIALDWRADLIEGWKIEGDNLVVTSGFDADDWQLREVIIKKAYRPVDNKRHIRNNKLTFVTKDGYHLVPDLPDTIEQSLPLDIEAVITQQGTPRSPIILNNQKTHRVAHDKDTSYYLSRLTASTTLQVIQRSDFTTTVHLDYASAELTRIEAHYNVQVTHDDDDWNTVKYGECGLTLYFGAHQVALKNLASSDERYTAQNTRTKRRAFSALGSNHLVTLIMNDGVSYRLVQPTPDYGLLLDETFIGQSSVGWKSDVSLPLTATRKKHMHLAPSDKSPYYMRNRATCAQLTSPSEQTGIEVLIGEGATYLVHLSPDMTLRLSTPGALAGAKPRLPNASTWELDATHLGTVEINLSANLLQIGTTIIHLPTYEAEDLVDKIRVITAQGIVYAVDTLFERVYVEALDARYFTFPLDPSAAWPSELSALATRDLQVLNIALKDGARGGLRYSLETRKWTLETDKTRLIESQDLRKTNLCDHHLNFYRDLASEGLGQNPPTDDGALRVLREKCVALAESLTLGNSKFLSQTLTLSLAFGMTAPQLSRLLSLYGSLPTLFTSPPIHMHHHHHH

SEQ ID NO: 1036 - protein, 451 aa, Artificial sequence
  Optimized for E. Coli
MGSFELVIGKVGGGKSLYAMHRLIEELLEEGPEARLVVTNLAVKEPELNEYIQQKHPMANVPLSKRLHVIEDEQIERFYEIRRLKDGTPWEGGIFYLLDELHAKFNARNWIKIETAVTHYLSQHRKLGDDVWGTTHLPEHVDRQMRNLSYAFHMLRNDYRTVFRMPILGIAVKPRSCFVRKSYYFDPTKQRNPQPYEVATFQLDAQGIANTYDTAKGVGIKGKKADTARMQKKGLPLLPTMIAAGIAIWAVFQVPKLWMERAYKAHQEKLAAAAPSSHHGTTPAPTLFDQIAPSSLESVTVIPAKPVDDTPWPTMKQIATWPAQKVSAERKTYRGIVRSGRRLRVYLDDGRYLTEADILTVGKGVVVTRDGAVLFERVLKPGDIVQTPREGFQGPAPVSVPPPSPASPLQGTPAALAAPVVIEGPGVRPDPAKPFAGSGLDKPFGHHHHHH

SEQ ID NO: 1037 - protein, 149 aa, Artificial sequence
  Optimized for E. Coli
MDSTVSVKGVVTSIPCTITQKNNGIVDFGDVLTTRIDGSSYKSYQLVLDLQCDTPVNADTMLNLSLSGTEAPFGEGLLATDKEGLGIQFRWGDQKYPVNSAVSFSYLNHDHSVYMSVTPAKDDSVELEGGAFTATATLTVDYQHHHHHH

SEQ ID NO: 1038 - protein, 149 aa, Artificial sequence; identical to SEQ ID NO: 1037
  Optimized for E. Coli

SEQ ID NO: 1039 - protein, 1689 aa, Artificial sequence
  Optimized for E. Coli
MGISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFVFWKRKMSKKSFDKQHHHHHH

SEQ ID NO: 1040 - protein, 1689 aa, Artificial sequence; identical to SEQ ID NO: 1039
  Optimized for E. Coli

SEQ ID NO: 1041 - protein, 843 aa, Artificial sequence
  Optimized for E. Coli
MGPTVPTYNSRQTVDQGLPAPQVSVQTNPDTFGAGLGEVGNRIAGIFAQEQHKANVAQTQDAVLQFQSFADDQFNNTDSGLYTKQGKNAVGQSEAVLNNIRGKADELAQQVPESMRRDFMQQINQAGQQYKRQASTYEIGQVRQYEEGQFKALQESTVTAAQGQYNDPQAFTSTVKQGFTAIDQFADAHGWSDEERANAKNQLKERSADGALSAAANQNYMDFIAANGEPGDYDGAMRVSGSTGDARGLRNNNPGNIEAGQNNWEGQAGSDGRFAKFVTPEHGIRALGKNLLAYGDKGYDTVNEIVNRWAPASDGNNTTAYVKALCEQLSVKPDDQLNLSDLNVLKKLSAGIVKHENGSIPYSDGQLDTGLRAALGLTSLESPKRYTGNVAFDAASTQAQASYLRQAKSLQNEARTQLKAQLTDVISDAKASYLKGVEYPNPPSQAQLISAYGYREGNQRFADLENQRVAGQYIGSFRNMPSSSITTYVADLKTQLGTGEGFAGRADAFDHVEAAAKQVINLRESNPYQAAMDMGVYKPIASTNPADITSEIKNRTAAIDQLKSLGINAPILSKEEAASISERVRGTTDVNQSISLLQSFGRGLQPQALRSVAASIAPDSAATAYSALILGTDDNQYNNRSPSIPYSQFVAYKPTMNKYEVAKTILQGDQLINPTKAQKDAGISAVKLPADDKLKQTFDDEIGNAFSHNPQARQMAWSIYKSAYAGLAYTSGDSDGVNTKSVDSDIAEKAIQMATGGVIKGFNGGDVVMPFGMDKSTFKDRYTAAAGDALKSAGLNPASQSNFVPVNVGDSQYRLVTGSGRWATDPKTGAPITVRVQHHHHHH

SEQ ID NO: 1042 - protein, 508 aa, Artificial sequence
  Optimized for E. Coli
MAIDYNLFNYNYPVSAYYPKSSDKANVMGRIIKINNVRNDYSVSIPIDVSQNSEGKLNYFGLTTSTNAYFTHDSGNSITNAGSLTGPNTLVGPGLQNPVKLPIPSSTITIDGQTYYFNYYVVQVVTEKVISPINEVQGNNYALQPLDTLPANANFAWAYYSDSPGAIIHYKTEDGTELLTSPTLISESGDTIPSEVRDFTGYTLVSVPEEDSFKKAQLTNLTYVYRKNPVAAATVTVKYIDTQGNYISDSIPLSGNVDQEYTTEQKIISGYTFKEVQGNKSGLFSTTPQTVTYIYAKNPIEIKAGSVTIKYVDTNGNSISDVITKSGNVGSSFDSEQKVILGYTFKEVQGNKSGLFSTTPQTVTYIYTKNPIEIKTGTVTIKYVDTNGNSISDEITKSGNVGSLYTSEQKKILGYNFKEIQGIAEGQFTIESQTVTYVYTKISPPTIIKTSVIPPKTLSVKTLPKESLPETGNKFFGFTLLSGSLLILVSTTLYLLKSRKYKHHHHHH

SEQ ID NO: 1043 - protein, 508 aa, Artificial sequence; identical to SEQ ID NO: 1042
  Optimized for E. Coli

SEQ ID NO: 1044 - protein, 521 aa, Artificial sequence
  Optimized for E. Coli
MGNIKTFKFIDKYSNGIVVNFDNRNKKTVTISLFLDNENIKTISTNNDHYLFKVDKSGNYHVTISFIDSNKNIHHLIDSPASYYFAQQKTKQNIKKESKSKTINHKIDGINKYFLEIKSEIKSSHLIMDILPNELMNSKLILIKSNIESSVKQYEYLNLYGEDNFDRLLELSQKIEQLDYVSYCCICPDTTGYLPPKLPLNSQVLEEDTSSNEITPNFTYLQKYLDAPMGMNVRNAWEKNIDGSQAVVRHLDFGVYKNHEDLKNSNLIVVNSRPETQDCNHGTASTGCIIATKNAFGVTGIAHNCQFYFYDTDDLDQLTNDAQPGDIVSLDIQFSFGEKLLPATAVRNWWERIKIMVDKGATVILAAGNGGLDLSEPGVMTDFGDNGSMLVGACNNQTGSRAYFSNYNQKSSLINSWGDWSVTTTGYGSLQKYPGNERNYTKDYSGTSSATPLCAGALALLQGYAKQHQIILSAWGMRELIKKSTYTEGVNDGIGYRPNVNDLLKEIDKLAQITEHHHHHH

SEQ ID NO: 1045 - protein, 540 aa, Artificial sequence
  Optimized for E. Coli
MGQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKIHHHHHH

SEQ ID NO: 1046 - protein, 540 aa, Artificial sequence; identical to SEQ ID NO: 1045
  Optimized for E. Coli

SEQ ID NO: 1047 - protein, 539 aa, Artificial sequence
  Optimized for E. Coli
MGQKPSNGDSYAKANIYVCFSKGIASAKAAFAQNPELEKLARENSMSFTYDLGFTDEKLSEMARNSKLNGYSPESVEKLKRIFKADLPLQNEEYAQRLAQALERFPEVEYASVMSSTPVEPPLINAFVATPDLENLQTYLNDNPGINAKYAWSRGITGQNIRIRDVEYGFYKTHEMLANQNSIQLEPGYSPNSGLSNNNYRDHGTAVVSILGSVKDNIGLTGAVYNASEIKGYMEWTTVGYNRAAAVSRSINASQAGDIILYEMQTGGKDGQYCPAEYDKVIWDLTKAATDSGIIIIAAAGNGNQNLDDPFYASYMSRGNSGAIIVGAGSPNTTHSKLSFSTYGNRVDVQGWGSSVLAAGYGSYAKYDNDNNRTYNYFSGTSSATPTVASAAVLIQSYYRQTTGQYLSPAAMKNLLISTGIPQGGTVANQKIGPLPNVKNAILQLEGKSATAVKALPSLEVKIYPNPSQNVITLQNVENKKLDFEIINMQGRSVIRGTAMPEEKIDLSSLLPGQYIITISEGQRRVVEKLIKQHHHHHH

SEQ ID NO: 1048 - protein, 539 aa, Artificial sequence; identical to SEQ ID NO: 1047
  Optimized for E. Coli

SEQ ID NO: 1049 - protein, 539 aa, Artificial sequence
  Optimized for E. Coli
MGQESQPKLNQDQNSIIYVCFSKGINSEKTAFSRNADLERFSRENKISFKYDLDFTDGKLDEMARNSKAIGNSSESVEKLKRIYKADLPLQNEETTQKIIHSLERFPEIEYVSVMNATPIEPPLINAFVATPDLESIQTYLNDNPGINAKYAWSRGITGQNIRVRDVEYGFYKTHEMLTNQNSIQLEPGYSPNAGLANNNYRDHGTAVVSILGSIKDNIGLTGAAYNTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTSPLEVKIYPNPSSSSIAIQSTENKKLDFEIINLQGRTVIKSSVLSDEKIDISQLSTGQYIININEGQRRVVEKFTKLHHHHHH

SEQ ID NO: 1050 - protein, 539 aa, Artificial sequence; identical to SEQ ID NO: 1049
  Optimized for E. Coli

SEQ ID NO: 1051 - protein, 540 aa, Artificial sequence
  Optimized for E. Coli
MGQDSQPKMANDQNSIIYVCFSKGINSEKTAFSRNADLERFSRENHISFKYDLDFTDNKLDEMARSSKAIGNSGESVEKLKRIYKADIPLQNKEASEKIIHILERFPEIEYVSVMSAEPIEPPLVNAFVVTPDLESLQTYLNDNPGINAKYAWSRGITGQNIRVRDVEYGFYKTHEMLSNQNSIQLEPGYSPNAGLANNNYRDHGTAVVSILGSIKDNTGLTGAAYSASEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTFGNRVDVQGWGSSVMAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSALEVKIYPNPSSSSIAIQSSENKKLDVEIINLQGRTVIKSSVLPNEKIDISHLPTGQYMININEGQRRVVEKLTKLHHHHHH

SEQ ID NO: 1052 - protein, 540 aa, Artificial sequence; identical to SEQ ID NO: 1051
  Optimized for E. Coli

SEQ ID NO: 1053 - protein, 697 aa, Artificial sequence
  Optimized for E. Coli
MGQILSTDNLPTLGLGSDAFQFDPLPSSDGTERFLAKYGQNAANLTSEENKTKNLSEMAQDYARQKAADVATDEISHWLSKAGNARLNINLDKQLSIKNTQLDWLIPWYDQPDLLLFSQHSIHRTDGRLQTNHGIGLRHFNQNSMMGLNTFFDHDLSYHHSRLGFGLEYAQDYAKISANSYLRLSSWRSTSELKDDYDARPANGWDIQVEGWLPTYSNLGANLKLEQYYGDDVALFGKNKRQKNPMATTVGVHWTPFPLLGINAEHKIGNGNTNETRVNLGLTWLLGKNLAQHLDVSAVDATHRISSNRHDFVNRNNNIILEYQNKNLILLSLPQVIQGVTGEEVSIIRNLISEYPLEKIIVEAPELVAAGGSITLNGLKSSVKLPSYKIEENDVKNQQLNRYRLTVTAYDIKGNMSPQAETLVEVSNTGLLAIIHKNGTKKSNVIANGRDPNVFTVVIKDALGHTVPNAKVNFTLPVGLTSFNQKNTSYYSLFNHFMWKAQVAKSASEQEFAIIANSKGEASIQFTASVSGSYALKASTQYGAEINEQFNFKPDIDQSFIGSIEIMQNNALADGNSKNKIKFHIVNNSRQSIAGAQVYFSGKNVAISPTIPTDEQGNTELEISSLTAGTTEIIATLNGDSRVIPVNFIDKNATYHSQENRIVYKGALFRQPTHKPATQTDSLWHLFGQLFHHHHHH

SEQ ID NO: 1054 - protein, 697 aa, Artificial sequence; identical to SEQ ID NO: 1053
  Optimized for E. Coli

SEQ ID NO: 1055 - protein, 1278 aa, Artificial sequence
  Optimized for E. Coli
MGSRLKLSRNQHRAVSGANADQYRTTAPVFGLMTSAHRAATILLFILCFFFASLAQAAVNTGLSGDDRYAGRFPIGFEFQYYDKTYNRFYVSTNGLIQFANPSIDYDNTCLPGELNNTLYVFWDDLRTNVDGQPTGKIEYQTLGDAPNRRLVVQWTNQYYFGTNLPMGTFQAILYEGSNQIKYQYRNLLDERSRGDSATVGLQGPEGQFAQFGCNEANLLESGQAVTFTPSEDGLSYVVDGQAEYDFIDISGFTVDYPALLSAYTNQAPGWEWNRNSDLNAYQIDIQNAAGESVLQEIVGNVGQYIYQAGDIHGATWRAKVRGSINNGATWEIWSGLSSPVTVDKVKPSAAVSEFHRLSAESARISYQTTDDLSGVKSIQLQVASDAAFENVVLETSLPVNRTQYQLTQLPQAASLYARIHAVDKAGNRSDDSAVVELLIAAPSLITPVNGTRVDEPFITVSGITYPEATVQLFLDGTALETSVQADETGYFTTVIALGEERNYRLSAQAQTPLGASSASYEVQFSYQEVGATVLFAAPNADAVLTAPTEVTVIASDRSGIDNVALYVDDALLATLTEAPYSFMWQLSESDNGARTLKAIATTGKGKTFEASTNVTAEVLPPVAPPTPYTGKVNSVSPAVSYGEPIVIEGQAVERATSELMANTPLRIVLINNGFKRTIAVSSDDNGLFRYSFVPQSTDKGTYSVAVIHPNETETVAQGKFTINRVNVHIGGYNLIAARNVPAKIDVKATADSGSLGFYWTIRAEDQPDGQLPQGIRINSTPTNIPVGSTTSTHVTFNADDSAAETGHLYLVAFANESGDIVRGKLQIKYRLTEAQPALYTTPGFIETGLAQNSNITETVTLANRGLTTAQNVNLTLQDEQGSAAPSWVFLANEADIQTVKVGDTVAVNVTAQPDDSVADGIYRFNLHVRADNQASFNVPVVISVIQNGTGGVRFDVADIYTATLDANGQPILGVAGATIKLQNEAALGSQRAATNRNAITGEYTLKTDNNGLAAVDSLPPGIYLYRASAPKHEDVTGRVRIRPGVMNNEHIFLNYEIINIEFSVTETTIKDVYDVNLDVTFNANVPAPVVILEPRTINLYGMQVGEEKTGQLTLTNYGLVRADDLTFKFPQSDERFHYEFFGDIPDQLLPKTRLIIPYKVTKLKASPFPRSLVTPLSKLARSNNENCFDYNNDAQAQYGYTCANGDTSSGSDNSRFYERTGEDCEPGAPWEEDEEKENENEPKPPSTPMTDGCSQDCEGCCSPGNGAGNSYHHHHHH

SEQ ID NO: 1056 - protein, 423 aa, Artificial sequence
  Optimized for E. Coli
MGNNITEYNDTANFVPYNVYATSAFEFDWDSSAILKQAVLKGISFIPYVGDYLSSIIGFFWKDQERDIWQEILGRVQQLIEENVLKAIKGILLGDIAELKGKIASVVAALQDHPGTPEAKSLFMSVSVHLDSVQRKFTTFDHKTNYHILPMYSATALMQIMYWTMGIERKDDIGLNSNEVGQLQRNINLLVTHVEDYVQGIYDTELEIQYNDSAPNTVANNVMYVHGYCRVHGLEYTEIIQSIQNNGSNTKGLYSKILSYSTFFGWPTSQARILALKDEVNMPEPFKPKLINGRINQVKSVKGYIRRIGGALRVGGLEITFENGSKYSQGTVTGEFSSIDLNGSVIETMETWGSGAIDEAKFTLSDGRTFTVGQRYSTNYRKFALEGHYISGIFIASDRSELAGQAANICVSYHQKQHHHHHH

SEQ ID NO: 1057 - protein, 143 aa, Artificial sequence
  Optimized for E. Coli
MGSKVTITIDSNSNEVDVKNSTEADTESLALTAAQVRTRVPTEVAPNSSTEVLYRSTPIIPESRRNVMITNDGAANVITAQYYWSHSFTSQWFLYTSIDVNVGDSKLLVSPSNSLYYSKVVLINNTSRKAYVTAEEKHHHHHH

SEQ ID NO: 1058 - protein, 444 aa, Artificial sequence
  Optimized for E. Coli
MGNDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHASSTIDKARRDNPHSTVGLAQNMPLSAMLIEKTKYQLTVLDLRDTWANLDPIRYPGKSRIKLDREIFTPVIGWLGRKNSRPDVIPVWRRPSSPLSSLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLIHHHHHH

SEQ ID NO: 1059 - protein, 471 aa, Artificial sequence
  Optimized for E. Coli
MGSNPQIDTHGPRAPNPFHGHVFQPASRSYFAYENGQLDVGALNQRESGKFFPASNAGLRDSFAPDDQANARPPADGKIASAEQLTGQFLDEPGTHWTKHKVGSKKTLDVSWYFAVAHVTRRWNYFITKPDWDPSLPLSRDQFEEKPFYVVQINLEPFWSHSSAMKPSNPTVHQVPLPERTGYHVLLAVWEVADTGNAFYQVVDLEFAATETPVVGPSTPENLAASEIKEKSVKLIWDRSEGNADVAKYCITRNGITTIDVAVPNLEWTDYSVSPDTRYTYFVHAVDVMGGVSAPSRAIIVNTLPEGGINAPPTAPGLLHSMKETKNCVSLMWSASNSAVGVAKYVVYREGSEIARISGNQTTYDDATLASDTQYRFFVAALDRNDRLSVPSNVLTVRTKPDVGDDYPAWKLSGAYKAKDIIRHNGQIWVCLQSHIAYAEAWAPGASDSMTLWQAYAGNIKQHCLHHHHHH

SEQ ID NO: 1060 - protein, 433 aa, Artificial sequence
  Optimized for E. Coli
MGHGFVGDDSGNPTHTLTARAALKANGDMGGAQWEPQSLEAPKGFPASGPADGHLASAGHEQWSALDEQREDRWQKNVVEQGDVTVDWTFTAPHMTSQWRYFMTKEGWDPNDALDRDDLELIETVSHDGSAASNNPSHEITIPSDREGYHVIYAVWDVADTANAFYNVIDVDVQPADGETPEPGEDTEAPGLVPDAAVRAVSSTEAEITWGAGSDDRGVARYQVVQLGSTQDEFRVLEEHAATARSTRLTGLQPGALYSFGVRAVDAAGNIGVAHSILTVRMPEQAAAPAAPKHLHDMGTTESTVALMWTAGDDTAGVRYEVFRDGERVGETGATNFVDVGLRAGSRHEYTVRAVNLDGIASAASNTHVATTKGDAGSEYPSWDAHGAYTKGDRVTHQGSTYEAVQSHQGHGDPNWITALSLWRPLGHHHHHH

SEQ ID NO: 1061 - protein, 433 aa, Artificial sequence; identical to SEQ ID NO: 1060
  Optimized for E. Coli

SEQ ID NO: 1062 - protein, 452 aa, Artificial sequence
  Optimized for E. Coli
MGPGKNISPRHGRVTTPESRAVLARQRGLLPDDSVPNSLEAGKFFPLYAGGLLDPVAPADSPSGTPPADGKIASAGYAAGAILDEPRSDWQKHEVRSGDKLTVAWAYHAVHTTRRWNYFITHQDWNPAEPLKRGHFEASPFYKVEFSLDPNWEHTAALTPSDPTVHELILPRREGYQVLLAVWEVANTGAAFYQVIDLQFAGASEGQAPTAPQGLSASSVSKSTIGLSWLASAASSGSHIEKYTIYRDGLGYVVVRDLDELEYLDTLLQADTTYTYFVSATDNLGRESLPSTQVTVRTWGAGGEIPAPTAPANLHEMGRTETSITLMWTGSVSTRGLLYLVYRDAVEVARLPQRTLEFTDHGLAPGNTYKYVVKAIDTAGLYSPASNELTATTQGVPQVPQWSAGAVLYEVGDRVSHQGGVYSCIQRHVSNSGWSPTAAITLWQPAHHHHHH

SEQ ID NO: 1063 - protein, 458 aa, Artificial sequence
  Optimized for E. Coli
MAKHITNPISQNITPRHGHIFSPASRAYFAWQAGDLDEGALNQRESGKFFPAVAGGLLDVYAPEDVANSPPPPDGKIASASQATGLFLDQPGSHWQKHEVRGGEVLDISWHFTANHVTRRWNYFITKEAWDPSQVLSRDQFEAEPFYTVQINLKPYWSHGNAMKPPSPTVHQMPLPIREGYHVLLAVWEVADTAAAFYQVVDLDFVGREGGGGRPTTPTCLKASSITDKQVQLTWNASISSSTVALYRITRDGSTTVDVYVPLLSWTDNSVLPGTSYSYFVTAIDDRGNQSLPSMAIQVRTQAEGGGTAPPTAPVNLHSMNTTSNTVSLMWGASTGGYPLKHYNFYRDGKQVTTIPASQTSYTDSGLTPATMYRFFVAAEDTHGQLSVPSNVLSVTTSIGEGGETPEWKLGESYRVGDKVIYQGVKYACFQAHISNAGWTPAETVNVLWLLVHHHHHH

SEQ ID NO: 1064 - protein, 463 aa, Artificial sequence
  Optimized for E. Coli
MGKNIISKPKEGLSSRHGHVFSPKSRAYFAWEKGQIDDGMLNQREAGKFFPAKLSGLADPVAPTDVYSALPPRDGEIASANQGNARFLDQPGSDWPKHDVISSQLLPVRWHYSAVHVTRRWNYFITRKDWNPDLPLSREQFDEKPFFSVELTEQPFWSHGDALTPPNPTEHMLMLPERRGYHVLLAVWEIANTGNAFYQVIDLNFTDSTISLPPPAAPEALRVKGVTGNTISLTWSAPSVAAAYYTIYRDGVFADRVKAMEFTDSGLKEDTEYTYEVTSVDMSGTESARSHALTVRTQSSAAIDHPPSAPENLHCMQVTTNSISLMWSPSQSPVAIQCYILHRDGQVIARTPASQLTYVDSNLQEGTTYHYYVVAQNENGCLSAPGNQLAMTTERTSTTTPDPAPHRKWALRSTFSAGEIVSHNGSLWQCIQTHVAYSPEWAPGASDSATLWRLIKAHHHHHH

SEQ ID NO: 1065 - protein, 658 aa, Artificial sequence
  Optimized for E. Coli
MGNIKKYADNSKIIHVNHNFMQDNQSSLIRTFVIEEVNVQFIRLVFSLANMPSGSYIEITDRKRQHTRIFPLNNGATLDVTFYNNCIDIKVILPKNYHYNKNQIAELTYYEALPQDLTQIVEDSHDGRQPYMWYKNTPFFNPVRAVHFAAFNGYGGSCSFIGSANHVLTNRHVALGANSQIDPEAIKSSEMWVNWHNITNDFSSPITDIIHFDIDKVLTYGKEIGGVEDYALFTITDFDYQNAHVKTLFGGLKLQETINNERENIYIPQHGGAKPLQISARLVSSMHPFASITPQPEYGDLFILGDMEPGSSGSPLIGRETHNILGILWGRFLFTQHGISSPYLIDKLKDFISDSNIHIKAQDNIVSHNIEATPVDNAEIKVILGDKEQLIPFDTILVENHDGYSIVEMAGLDLTTRKTMPVKYKVLAIMSNHQVSHLNDPALIGEVTLRFIPYQHLQDTVIKSWFVARIERDGEIVNNYITRILSYNYDVFEIPFDVNNADCMPLIFDAKQANTILHPFTETNPNLSFYTLRHGQGPENVGEISDGYSILKTQVINAKGEKELVTFQAYRIKSVTASEPYPLISTPSRINVKCNYDFKGPSYLRVCYYPEDNLHLIGKGTFKGIIALHGSDESGSTDRLCKNILLDITINGHHHHHH

SEQ ID NO: 1066 - protein, 1268 aa, Artificial sequence
  Optimized for E. Coli
MGFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYANTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSWHHHHHH

SEQ ID NO: 1067 - protein, 988 aa, Artificial sequence
  Optimized for E. Coli
MGYTYANSVHKSVYSNNPVEQSSIGILSTSVYPDNAVVKYGEKIYINYSFNDKAHPVLINIYKDGDLQSDYYYEQSSWGDHFSYEPKDEGSYRFVVQPTDQPYYTNECTVTVYKDRIIFLPGIMGSELFLGDEQVWEPENSKNLPRIRSQINSLQMTTLGESKNNISVHNSISDYDDILAFFKNEGFHVVDFPYDWRLGSSINAQKLKERINIERAASPYSNYYIVAHSMGGIVATEFIRQGNSNLIKKMITIGTPFLGAPQAINMLETGNLTDNLLAVLLAGDAVKNLEKNVPSIYELLPTKDYFSYQTNGYIETQTYQDPYGPRMKVRKYNTFSDTESYIKNSRDWSNNGLFDKAKDFHSALDVLNTLKKVDSYFIVGDQKTTPGKLVYHSLSINDKVLADVKSIQGDGVVPVSSATVGFKLDKARTFYITRSHLGLVKSTEVQQKILKILKDKPNEFVSDKIRNETKEIKTIKFKAECPVELHINDSSGNHTGPTGAETFESNIPDINYFTDGETKIALVNDVENYKVRIVGTGYGELTFSIVWSNEKDIEDRTMRFDNVAVTPGSIFKADVNQNGQVVLQIDQNGDGNFEGSVSPTVELDLGGTQDETIPTISSHVDGVKGINEWYGKNAFYNLTGADNASGVYKTFYDLNDSEFKEYNEPIALPNTGIYNFKSYVRDKNRNDSEVLTEIVKVDTTSPTVPVMTVDPTTWTNKFVTITLDGGTDADSGFQKYQYKINQDGEWKDYKDPFVIDTEGLYNVYARSVDNVFNLSGEVTGVTKVDKTNPQKPLMKVEPLKWTNQSVEITLSGGSDTDKGFPNSGFQKYQYKIGLDGEWKDYTVPFIIDNEGLNNVYARAVDIAANLSDEVFGDAKVDKTRPSKPTGFDIDLFNYDNVRISWSPSSDNVGVTGYDIYQDSILLDNITDTAYTFNNLESNKSYTFKVIAWDEAGNSSLEGVNVVRTPLSLVGTGRDHSLHSMGSHHHHHH

SEQ ID NO: 1068 - protein, 988 aa, Artificial sequence; identical to SEQ ID NO: 1067
  Optimized for E. Coli

SEQ ID NO: 1069 - protein, 361 aa, Artificial sequence
  Optimized for E. Coli
MGPNLETGVAYNIALGTNPNLVFDILGNSTEYDALVGLYAKGNNSINQQFYFFELDGGKLAVVPRNSGRPLEPGFGDQPENRIVQGAWTGTISQQWALQDRTASSVHMFNQSDGAVASYGRNDQEQFPELNPPDPSGPNPERAWYLEPAYQALLPNMVSTTPIPSPPEYSSGIYEVLPDQSEVATVSNALIPCILVNDGSVSPDIKVQQSPYYLLIKQQYWQKAVFGTVSPNTTREFLFQSGTTSLDQQSMSDTINMTIGGDFGLQFNKVSAPAKFVISNQIQTVVSTTNEQLSGFTDTIEYRNIKKNVLVGVSIYQLVTRYVLYRTDGSLVAEPWKFIDNASAVTIITEQPIDAHHHHHH

SEQ ID NO: 1070 - protein, 799 aa, Artificial sequence
  Optimized for E. Coli
MASSEKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELEKGKLYKIKITYQPESSSANEFGLQLNWITPQGKEEIIPEGNLLLPDIKNQPENESSRKKRSISASDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINKDQLTILEQTQQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDEPGVHEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSVENNDKIMAWNAYQNSTNVFATAFEGKPEHFWIPELLGNDLYILKNKKDPTKVLDVDGSGTSNGSNIQVSDYKGTDNQKWKLEQLEANHHHHHH

SEQ ID NO: 1071 - protein, 625 aa, Artificial sequence
  Optimized for E. Coli
MAIRSHAPSVYVTPQNTAASDIISIDWSPVLTAPHTYWAVHNWNQGGEGGGYAGFQQQSGFDQTGKRTLHFALWDPIASNQAIKAEYLSPISEASRFGGEGTGLKVQTTYNWKDSEWYRMTIRSWQEDGHTKFGQWIKDNKLNQWKLVAIMDHPVANVAFNHGLSMFQEDWAGNGQDVREARLKNGYSRKVSDQQWNSWNNQCISGQHDTSYQYDGGATSEYIWVKAGGNTQSTIGTGKNFNINQPSQPEMGILDFDIQNIRFEDKKLNVSWKLKEQSTPQFKGKIEIYDNEKLMGQPLKVIDNIKSYQTEVSQTMQLPQTAFAKITLTDIFDRTVEKKVGITNGNSDILVGNQFACSLKGYSDREIAKVDYNKAAEELKIKLEAGVPHAYFNSTYASIKVQNSSGSVLYNKEIVGNRQQNTESQTVSVKVGNYIELTHIEGDAVKEKTRATLTNLENNKNETIGKTARYLVTKEGLKKVEKMPETTILDGKQFAWSLKGYSDREITKVDYNKTAEELKIKLEAGVPHAYFNSTYASIKVQSSSGSVMYNKEIMGNRQQYAETKTVPIKVGDYIEFTHIEGEAAKEKTRATLTNLENGKQEYISKKRTYQVTSTGLIRQHHHHHH

SEQ ID NO: 1072 - protein, 294 aa, Artificial sequence
  Optimized for E. Coli
MAAGVTNTAATDAGIVDWSTPIDHAMDIYGQHAGKPGTYGGSGLLGGFTDVKYREFSVEADGSPILSNSKTVFVGSSTLVNDSDMEQTLSTDSFTQQFTNSVTSSTTTGFKFGEKISSKFEIPLVAEVGAEVSTEFDFSDTSSNTKTETHTYTAQPQNIKVPPHSSVEVIVKLDTVKASGNVKLLSKMSGQKTGSIIYYNPSVQYFYNLSFHDIVDEASKYEKLSNVYANPDETITLVGAGNYEAEYGTQFMVQVMKPKPLNENGRVKRDLHEEDYAYEVTPVVNKAEHHHHHH

SEQ ID NO: 1073 - protein, 294 aa, Artificial sequence; identical to SEQ ID NO: 1072
  Optimized for E. Coli

SEQ ID NO: 1074 - DNA, 1284 bp, Artificial sequence
  Optimized for Arabidopsis thaliana
atgaagcttttggagcttaaatctgtttactctgaacaagagcaggaaagattctacactagatctatctctcttggagattgggattactctgctattatcaagtcttctgttatgttcggattgggtcaaattcctgttgttggaaaagctctttctactatcgttggtttgttctggccaaagaacgagaaagatgtttggcagaagtctcttgatgagttgagagaatacatcgataaccaaatcttggctacaattcagggaatccttaacggtgaattgagagaaatccaaaagaagatggaatatgttgctagacttttggaagagtctcctggttctccagaggcttgttctgaatacaaaaaccttcagttctatttggttggaaaggatgagaagtttagatctttcgatgaacttacaaactacaagttgatgcctatgtatgcttctatgattcttttgcaagcttcttattggaaaatgggaatcgataagaaagatcagattggtctttcttctatcgatcttaactctttgaagaaccatatcgatgatttggctgattcttctagaaactacattaacagaatctatgagactgaacttgatagaacatacgagaactctagaccagatgaagttgctaataacatgttcgctgttagaggatattctcttttgcatggtgttgaggctgttgaagttgttaagaacatcagagatttggatttcgataagagattcaatattaacgttatctcttactctactgctgttggtactattacaggaggtatgatcgctcaagctcttacacctgattctgagatggctcagcctttgtgtccagaagtttttggacaacaggctaacagaatcgttcaaattatcggatactctggtccaagaattaactctcttttcagaatcggaggtttggagattatctatgaaaacggagattcttctcttttgggagagagagttggtaatagagatgttttcgatcttaacggatctttgatcaagactgttgagatgagatatcaaggtcttatggatgaggttaagtttactttgttcgatggaagagttatgcaagttggacagggtgaatcttactctggttacgttaaatacgaggttgaaggacattacatctctggtgtttttctttctagagatagagctacttatcctggaagaacttctacagcttctgtttctttcaatatggttccagctatctctcaccaccaccaccaccactaataa

SEQ ID NO: 1075 - DNA, 1284 bp, Artificial sequence; identical to SEQ ID NO: 1074
  Optimized for Arabidopsis thaliana

SEQ ID NO: 1076 - DNA, 1344 bp, Artificial sequence
  Optimized for Glycine max
ccatggtttaggtctctctatctacatataaatacacaaaaaattccattatcaatgaagcttttggaacttaagtctgtttactcagagcaagaacaggagagattttatactaggtctatttcacttggagattgggattactctgcaattattaagtcttcagtgatgttcggattgggtcaaattccagttgtgggaaaggctctttctacaattgttggtttgttctggcctaagaacgagaaggatgtgtggcagaagtcacttgatgaattgagagagtacatcgataaccaaatcttggcaaccattcagggaattcttaatggtgaattgagagagattcaaaagaagatggagtatgttgcaaggcttttggaggaatctccaggttcacctgaagcttgttctgagtacaagaatcttcagttctatttggtgggaaaggatgaaaagtttaggtcattcgatgagcttacaaactacaagttgatgccaatgtatgcttctatgattcttttgcaagcatcatattggaagatgggaattgataagaaggatcagattggtctttcttcaatcgatcttaactctttgaagaaccatattgatgatttggctgattcttcaagaaactacattaataggatctatgaaacagagcttgatagaacctacgaaaattctaggcctgatgaggttgctaacaatatgttcgcagtgagaggatattcacttttgcacggtgttgaagcagtggaggttgtgaagaacatcagagatttggatttcgataagaggttcaacattaatgttatctcttactcaactgctgtgggtactattactggaggaatgattgctcaagcacttacaccagattctgaaatggcacagccattgtgccctgaggtttttggacaacaggctaacaggattgtgcaaattattggatactctggtcctagaattaattcacttttcaggattggaggtttggagattatctatgagaacggagattcttcacttttgggagaaagagttggtaacagggatgtgttcgatcttaacggatcattgattaagaccgttgaaatgagatatcaaggtcttatggatgaggtgaagtttactttgttcgatggaagggttatgcaagtgggacagggagagtcttattcaggttacgttaagtatgaagtggagggacattacatttctggtgtttttctttcaagagatagggctacttatccaggaagaacctctactgcatctgtttcattcaacatggtgcctgctatttcacatcaccatcaccatcactgataagagctc

SEQ ID NO: 1077 - DNA, 1344 bp, Artificial sequence; identical to SEQ ID NO: 1076
  Optimized for Glycine max

SEQ ID NO: 1078 - DNA, 1358 bp, Artificial sequence
  Optimized for Zea mays
ggatccacaggacgacccaagcaagcaagcaagcagcgagtacatacatactaggcagccaggcagccatgaagctcctggagctgaagtccgtgtacagcgagcaggagcaggagcgcttctacaccaggtccatcagcctcggcgactgggactactccgcgatcatcaagtccagcgtcatgttcggcctgggccagatccccgtggtcggcaaggccctctccaccatcgtgggcctgttctggcccaagaacgagaaggacgtctggcagaagagcctcgacgagctgcgcgagtacatcgacaaccagatcctggcgacgatccagggcatcctcaacggcgagctgcgcgagatccagaagaagatggagtatgtggcgcggctgctggaggagtcccccggcagcccagaggcctgctccgagtacaagaacctccagttctacctggtcggcaaggacgagaagttcaggagcttcgacgagctgacgaactacaagctgatgccgatgtacgcctccatgatcctcctgcaggcgagctactggaagatgggcatcgacaagaaggaccagatcggcctctccagcatcgacctcaacagcctgaagaaccacatcgacgacctggccgactccagccgcaactacatcaacaggatctacgagaccgagctggaccgcacgtacgagaactccaggcccgacgaggtggccaacaacatgttcgcggtccgcggctactcgctgctgcacggcgtggaggccgtggaggtggtcaagaacatccgcgacctggacttcgacaagaggttcaacatcaacgtgatctcctactccacggcggtgggcacgatcacgggcggcatgatcgctcaggccctcaccccggactcggagatggcccagcccctgtgcccggaggtgttcggccagcaggccaacaggatcgtccagatcatcggctactccggcccccgcatcaacagcctcttcaggatcggtggcctggagatcatctacgagaacggcgactccagcctcctgggcgagagggtgggcaacagggacgtcttcgacctcaacggcagcctgatcaagaccgtggagatgcgctaccagggcctcatggacgaggtcaagttcacgctgttcgacggccgcgtgatgcaagtgggccagggcgagtcctacagcggctacgtgaagtacgaggtcgagggccactacatctcgggcgtgttcctctccagggacagggctacctaccccggccgcacctccacggcgtccgtgagcttcaacatggtccccgccatcagccaccaccaccaccaccactgatgagagctc

SEQ ID NO: 1079 - DNA, 420 bp, Artificial sequence
  Optimized for Arabidopsis thaliana
atgaaggatcaattttctaataacgaaatcgagaagctttctagaggagttggtttggaaacttctcctgctgatgagtctgttcaacttttgtctggaggtactttcacagttccaaagcatggatctgttcaggctgctaagtactctacacctgttattccagaaatccataagtcttactggattttcaatgctggtaaagctaacaagatcaaagctgttttctattggtctcattcttttacttcttcttggttcgaatactcttctgttgaggttggaatcggtgaagagaagaaacttcaagctccttctaactctttgtactactctaaggttgttctttttaacggaacagatcagaacgctactgtttctgttacagttgctaaacaccaccaccaccaccactaataa

SEQ ID NO: 1080 - DNA, 420 bp, Artificial sequence; identical to SEQ ID NO: 1079
  Optimized for Arabidopsis thaliana

SEQ ID NO: 1081 - DNA, 480 bp, Artificial sequence
  Optimized for Glycine max
ccatggtttaggtctctctatctacatataaatacacaaaaaattccattatcaatgaaggatcaattttcaaacaatgagatcgaaaagctttctagaggagtgggtttggagacatctccagctgatgaatcagttcaacttttgtctggaggtactttcacagtgcctaagcatggatcagttcaggctgcaaagtattctaccccagtgattcctgagattcacaagtcatactggatttttaacgctggaaaggcaaataagattaaggctgttttctattggtctcattcttttacttcttcttggttcgagtactcttcagttgaagtgggaattggagaggaaaagaagcttcaagcaccatctaactcattgtactactcaaaggttgtgctttttaacggaacagatcagaatgctaccgtttctgtgactgttgcaaagcatcaccatcaccatcactgataagagctc

SEQ ID NO: 1082 - DNA, 480 bp, Artificial sequence; identical to SEQ ID NO: 1081
  Optimized for Glycine max

SEQ ID NO: 1083 - DNA, 494 bp, Artificial sequence
  Optimized for Zea mays
ggatccacaggacgacccaagcaagcaagcaagcagcgagtacatacatactaggcagccaggcagccatgaaggaccagttcagcaacaacgagatcgagaagctctcgcgcggcgtcggcctggagacctcccccgccgacgagtcggtgcagctgctgtccggcggcaccttcacggtcccaaagcacggcagcgtgcaggctgccaagtactccaccccggtcatccccgagatccacaagagctactggatcttcaacgccggcaaggcgaacaagatcaaggccgtgttctactggtcccacagcttcacctccagctggttcgagtactccagcgtggaggtcggcatcggcgaggagaagaagctccaggcgccgtccaacagcctgtactacagcaaggtggtcctcttcaacggcacggaccagaacgccaccgtgtccgtcacggtggcgaagcaccaccaccaccaccactgatgagagctc

SEQ ID NO: 1084 - DNA, 1377 bp, Artificial sequence
  Optimized for Arabidopsis thaliana
atgactacaactattatctctactaagaaaaatggtcctggattgagacatggtcatgtttctacaccagagtctagagcttattttgcttggcaagaaggtagattgaattctggacaacttaaccagagagaggctggaaagtttttccctgctactgcttctggattgacagattctgttgctccaacagattctactaatatgcttcctccacctgatggaaagattgcttctgctaaccagggagatggagagttcttggatgaacctggaactcattggaagaaacattctgttgagtctgctgaacttttgaaggttacatggtattactctgctccacatgctactagaagatggaactattttatcacaagagaaggttggaatccaaacatgcctctttctagagctcaatttgaggataagcctttctacaaagttgaattggaagagcagccattctggtctcatgctgctgctcttaatccacctaaccctactgagcatttggttatgcttccacaaagatctggatatcatgttcttttggctgtttgggaagttgctaatactggtaacgctttctaccaggttattgatcttgatttcatcggagatgtttctccaacaactcctgttgctccaggaggtttgagagcttctgcttctacaacttcttctattactcttaagtggaatgctgctgcttctgctgctgagtacagattgtacagaaataacactcttatctattctggagatcaattgtcttttacagataacggacttcctgaaaacacaacttattcttacgctgtttcttctgttaatgaggctgaggttgaatctgctttctctcagccaattacagcttctacttcttctgatgttaaccctgatacaccacctactgctccaacacatttgcattctatgggtatcacaactaattctgtttctcttatgtggggagcttcttcttcttctgttaaattgaacggttatcttgtttacagagatggaaatgagattgctagagttaacgttgctcaattgtcttacacagatactggacttagacctgctactgcttacagatacttcgttgttgctgaagatatccaaggacagttgtctggaacttctaacgttctttctgtttctacagataaggatgaggatgattctggaggtggaacttatcctcattggattttgggtgaaacataccatgctggagatatcgtttctcataacggaaagaattgggtttcttatgttacacatgttgctcattctcctgattgggctccaggacttgctttgtctctttggtacgagcttattcaccaccaccaccaccactaataa

SEQ ID NO: 1085 - DNA, 1377 bp, Artificial sequence; identical to SEQ ID NO: 1084
  Optimized for Arabidopsis thaliana

SEQ ID NO: 1086 - DNA, 1437 bp, Artificial sequence
  Optimized for Glycine max
ccatggtttaggtctctctatctacatataaatacacaaaaaattccattatcaatgactacaaccattatttctactaagaagaacggtccaggattgaggcatggtcacgtgtctacacctgaatcaagagcttattttgcatggcaagagggtagattgaactcaggacaacttaatcagagagaagctggaaagtttttcccagctaccgcatctggattgactgattcagttgctcctacagattcaaccaacatgcttccacctccagatggaaagattgcttctgcaaatcagggagatggagaattcttggatgagccaggaacccattggaagaagcactctgtggaatcagcagagcttttgaaggttacttggtattactctgctcctcatgcaacaagaaggtggaactacttcatcaccagggagggttggaaccctaatatgccactttcaagggctcaatttgaagataagccattctacaaggtggagttggaggaacagcctttctggtctcacgctgcagctcttaaccctccaaatccaacagaacatcttgttatgcttcctcaaagatcaggatatcacgttcttttggctgtttgggaggtggcaaacaccggtaatgctttctaccaggttattgatcttgatttcattggagatgtgtctcctactacaccagttgctcctggaggtttgagagcttctgcatcaaccacttcttcaattactcttaagtggaacgcagctgcatcagctgcagaatacagattgtacaggaacaatacacttatctattctggagatcaattgtcttttactgataacggacttccagagaatacaacctattcttacgctgtttcttcagtgaacgaggcagaagtggagtctgctttctcacagcctattactgcatcaacatcttcagatgttaatccagatacccctccaactgctcctacacatttgcactctatgggtattactacaaactctgtgtcacttatgtggggagcatcttcatcttcagtgaagttgaatggttatcttgtttacagagatggaaacgaaattgcaagggttaatgtggctcaattgtcttacaccgatactggacttagaccagctactgcatataggtactttgttgtggctgaggatattcaaggacagttgtctggaacttcaaatgttctttctgtgtcaacagataaggatgaagatgattctggtggaggaacttatcctcattggattttgggagagacttaccatgcaggagatattgtttctcacaacggaaagaactgggtttcatatgtgacacatgttgctcactctccagattgggctcctggacttgcattgtctctttggtacgaacttattcatcaccatcaccatcactgataagagctc

SEQ ID NO: 1087 - DNA, 1650 bp, Artificial sequence
  Optimized for Glycine max
ccatggtttaggtctctctatctacatataaatacacaaaaaattccattatcaatggcatcttcaatgttgtcttcagctgcagttgtgacttctccagctcaagcaacaatggtggctccttttaccggtcttaagtcttcagctgcattcccagttacaaggaagaccaacaaggatattacctctattgcttcaaacggaggaagagtgtcatgtatgaaggtttggccacctattggaaagaagaagttcgaaactttgtcttacactacaaccattatttcaacaaagaagaacggtccaggacttaggcatggacacgtgtctactcctgaatcaagagcttacttcgcatggcaagagggtagattgaactctggacaacttaatcagagagaggctggaaagtttttcccagctacagcatctggattgaccgattcagttgctcctactgattcaacaaacatgcttccacctccagatggaaagattgcttctgcaaatcagggagatggagaatttttggatgagccaggaacacattggaagaagcactctgtggaatcagcagagcttttgaaggttacctggtattactctgctcctcatgcaactagaaggtggaactacttcatcacaagggaaggttggaaccctaatatgccactttcaagggctcaatttgaagataagccattctacaaggtggagttggaggaacagcctttctggtctcacgctgcagctcttaaccctccaaatccaactgaacatcttgttatgcttcctcaaagatcaggatatcacgttcttttggctgtttgggaggtggcaaacaccggtaatgctttctaccaggttattgatttggatttcattggagatgtgtctcctactacaccagttgctcctggaggtttgagagcttctgcatcaaccacttcttcaattactcttaagtggaacgcagctgcatcagctgcagaatatagattgtacaggaacaatacccttatctattctggagatcaattgtcttttactgataacggacttccagagaatacaacctattcttacgctgtttcttcagtgaacgaggcagaagtggagtctgctttctcacagcctattaccgcatcaacttcttcagatgttaatccagatacacctccaaccgctcctactcatttgcactctatgggtattactacaaactctgtttcacttatgtggggagcatcttcatcttcagtgaagttgaatggttatcttgtttacagagatggaaacgaaattgcaagggttaatgtggctcagttgtcttacaccgatactggacttagaccagctacagcatataggtacttcgttgtggctgaggatattcaaggacagttgtctggaacctcaaatgttctttctgtgtcaactgataaggatgaagatgattctggtggaggaacttatcctcattggattttgggagagacctaccatgcaggagatattgtttctcacaacggaaagaactgggtttcatatgtgactcatgttgctcactctccagattgggctcctggacttgcattgtctctttggtacgagcttattcatcaccatcaccatcactgataagagctc

SEQ ID NO: 1088 - DNA, 2994 bp, Artificial sequence
  Optimized for Arabidopsis thaliana
atgcaaaataacgataagatcccacaggttgttcttccaacacctcaagctcagttgtatgagaaatacgttaaccatcctactgttgaatacactggtacaccagagattacaatccctctttacgaaatcactgttaagggacttaagatccctatctctttgtcttaccatgctggaggtatcaagtatggtcaatttgatggagatattggagctggttggactttgtctacaggaggttacagagtttctagaacagtttatggacaaccagatgaacagtatgatatgtacgatcctaatgagcttgaagagatgtggaacagaccatggacaggagatattagaaagaaaatcgagagagatacttacttcatgggacttgaaagaaagttgcatcaggaggcttacgttagaactcaagattctcagcatgatcttttcaactacatcttgcctactacaactggtcaatacatcatctctgataagagaaataagactgttgttacagataagcagaacggagataaaattatccttgatgagggaggttctctttctttgaactctatgaaaattatcgatacaggaggttttacttatcttttgggaggtcaacagacaaacccatctgctcttttggttgaaacaactcttatccctggtacttctgcttcttttgctgataaggctggatggccattgagacaaatccagtctccttacggaggtaatatcgatttcacatataagctttacgaattgccatctgagaacagatttggaggttctttcactcttacagatgcttcttatttcattgcttctgctgctacaggacctcaatactctactgcttctggttctgtttctttgtctaacggaagatataagcagtactacatcgaaaagatcacaactgataaggagactattatctttaaaagacttggtttctctgttccaggagtttctcctgctaatacacatgctctttctgaaattgagatcagagctaaagataacactttggttaagaaaattatctttaatcataagaaatctccagagggtaacacaactatcgatggattctggcatatgcttcttacatctgtttctatctctaacggaacaggtgaacctcaaacttattcttttgcttacaacgagccaactctttcttctcctgtttatgctgatcagtggggttattacaagaatgcttacgagggaagaccaggaggtagaattatctggaacaagctttttcttcataaagaattcgctgatgaggttcttatgccatggacaaaccctaatcattcttatgaaccaactcctttgaaatatgtttggaatggtacataccctggaactgcttcttacaacttcgttgatagatctaataactcttctgctggtcttcatttcttttctttgtctagaatcacttatccaacaaagggatctatcgaatacgcttaccaacctaacaaatacgaagctggaggtgagacaatctctggatctggtcagagagtttggaagattatctctaacactgaagatggtaaaccatctatcgttactgagtacacatacggaaagaacggagatggtcttggttctgtttcttcttctgcttacttgtctgatagatttttcgctacaactacaatcctttctgagattatctcttctgatgttacattggtttcttctaataagttttctcaagttagaacttattcttcttctccataccaggctgatcttttggatttgatgactgttgtttatcctgaagttactacatctcaatacgatacatcttctagatcttacaacggaaagattgtttctacttaccatatcccttttaaaatcggttgttcttctatcggaggtacatctattcaacttggaaattaccctccacctactaagtactggaacgattactacattaacatctacaacttcggtaaccagccatatcttaagtctagagttacatacaataactctaatcttcctttgatcagagagtctttcgaatacgagaacttgaagtctcaaattttcaaaggaatcagagctatccaaaagcagtcttgtgttgatagaccagttttcctttattacgaattgtacgagtctccatatacttacattgatcctatgtgtattgctgatagaatcgagactacacttaacttcaacagaatcaagtctaaagaagttgtttctttcgagggatctgattctattaaagttactgaaacataccaatacgatgctttgaatagagttacaagatctgttactacaaacggtatcggatctacaagacaaattgaatatacttacccttcttctggtcagcttgttactaagaataagattggagagccagttagaacaaagacaattaataacaatatccctacaggtatcgttgaaaagacttacccacttaacgctatcaacccttcttctttgagatcttctactggaaacgagtctactttgagaacagatatcacttacaaccaatacgattctaagggtaaccttttgcagtatacaagagctgatggaactatcgtttcttacctttggtcttacaactaccaatacccagttgctgaaattgttaacgcttcttacactacagttacaaacaatctttctggtgttactgctgcttctttggctggaaacgctaatcctgatgatacagttctttctgctgttaaggctttgagaacacttttgactaacgctgaagttactgtttacaaatacagaccattggttggtattatcgagcatacagatcctcaaggaatttctacttggtacgattatgatgatcttggtagattgagagaaacttgtttcaaggagttcggaattaaaagaatccttgaatcttacgattataattacagaaaccagcaccaccaccaccaccactaataa

SEQ ID NO: 1089 - DNA, 2994 bp, Artificial sequence; identical to SEQ ID NO: 1088
  Optimized for Arabidopsis thaliana

SEQ ID NO: 1090 - DNA, 506 bp, Artificial sequence
  Optimized for E. Coli
ccatgggtcaggaagacacctaccgtggtgatggcctgaacctgtacgcgtattgcgcgaacaacccggtgacctatttcgacccgagcggtaacaacggcctgctgaactgcccgcaaccgggttttgcgccgggtaacggcgacccggaaaccctgtaccactataccaacgaaaagggcaaagatgcgatcctggagagccaggaactgttcccgagcctgaaggcgaacaacccgaaagacgcgcgttacggtaacggccaatatctgagcgatattaacccgaccaccaccaagccggcgagcctggcgagcaaattcatccgtaccccgaacaagtacaaatatacccactttgtggaaattgacgttagcgatctgaacgtggttcgtggtcgtgacggcgtgtttgttatcccgaacaacaacagcctggatatcagcggccgtattgtgagcagcggcaaggttggcagccagcaccaccaccaccaccactaataa

SEQ ID NO: 1091 - DNA, 2814 bp, Artificial sequence
  Optimized for Arabidopsis thaliana
atgattactcctcaaatttctaatatccatgctggaactccaacaatcactgcttttgataacagacatttcacagttagaactttgcaatactacagacagcctaatattcaacaggatgttcaggaaagacttgagttccattacttcaacatctatggatttcttcaaaagaacgctgatgctagactttctgaatctggacaggataacttttattaccatgctgatcttatgggtttctctcttttgaataagggagttgattctggtgaaatctatcaattgaacgatatcgagcagagacttatggtttctatcgatgctaataagacattcaaatggtgttgttacgaagctaacgattctcttggaagattggagtctgtttctgaaaagatcgagggaggtaactggagagtttctgaaagattccaatacgctggtaattctcatactgagcaacttgctaacttggctggacagtgtatttctcatttcgatacagctggtcttttgcaaactcaggaagtttctcttcaaggagagcctacacttttgactagacagtttatccaacaggttgataatgctgaattcaacgttgattggcaagaggattctgatcttactgctttgtctccagaaaaattttctcatcagacacatttcgatgctgctggagcttgtttgtctattatcgatgctaagggtcataaacaacagagagagtatgatattactggacaacttatcagaactacttttactgttaagggtcaagatacacagccaattactcaaattatcgaatactctgctgttggtcagaaagttagagagatctatggaaatggtgctgttacagaatacgtttatgaggctcaaactcagagacttattttgatccaaacatacagacctgttaaccattctcttggatataagttgtttcagtctcttcattacgattatgatccagttggtaatgttattgctatctacaactctgctgaaaagaaagttttctggagaaaccaaaaggttgagcctaagcatagataccaatacgatactctttaccagttggttcatgctacaggaagagaaattgctggtatctctcaacagtctcattatttgccacatcattcttctatcgataactctgtttacactagatacttcagagcttactcttacgataagggaggtaaccttattcaaatccatcatagagctcctgctatgcaacaggcttacacaatcaaaatgactacatcttctagatctaaccatgctgttcttgctgatttggctgaatttccacatcaggttgagcctttgttcactccatctggacaacagaagcaacttttgcagggaaagaatcttacatggacttctagacaagaacttcagtctgttaacggagctggaggtaacgagttctacagatatgatggagattctcaaagagctcttaagattacacagtacaaccaaaagcagtctaaggttgtttatcttcctaatttggagatcagacaaatcgaacataacgagaagtaccatgttatttgtatcggagaagattctgaggttcaagctcaggttttgcattgggaaatcggtcttccagataagatggttaataacactgttagatactctattaacggattgacatctaactctggtcttgagttggatatggatggaaatcttatctctcaagaagagttctatcctttcggaggtacagctgtttggactgtttcttctgctttggaagttaactacaaaactagaagatactctggacaagagagagatatcacaggattgtactactacggtagaagatactaccagccttgggttggtagatggctttctgctgatccagctggaactatcgatggtcttaacttgtacagaatggttagaaataaccctcttacatatcaagatgaacatggtttggctccaagactttttgatactcaggatgatatgtttgctgatttccaacagacagtttctaagcttttgaatgcttcttctaagattgagagaatcgctaagaacccttctttgatcagaaacagagttatctctatggctcaacttttctataaggataagacatctaaattcacttacgctattaacttgtacgaattccttgagatggattctcaatctgaagagttcaagacatgggctactaataagctttcttatcagaacacttctagacaaagacagccaggatgggaaacagttaatcatgctgagcaagctttgattagaacacttactgctcatgattctttcaatatctctaacttgattatctctcaaaaggctaaactttgttcttcttgtgaaaacgctatgtatacttttagacagtctatgcctaagagaagattcactacaatgattttgagagatggagatcttccattggctgctatccaacatggacagtctagaactagatacaaaaactcttcttactctgctggagttgctgttggaaagacttcttttactctttacgattataaggatatcgagttccaagttggaatgggtaacttctggggaggtatggataaaacattgtacactatgtatgctaatgagtttgagagagttttcggaaaccttcctatcggaaaaggtgttaagaaatctttccctccaaagcctccaaaatcttctggaggtagaggtcatcaacttgataaaaatcagccatctacttctagaagacatagacaccaccaccaccaccactaataa

SEQ ID NO: 1092 - DNA, 2814 bp, Artificial sequence; identical to SEQ ID NO: 1091
  Optimized for Arabidopsis thaliana

SEQ ID NO: 1093 - DNA, 1581 bp, Artificial sequence
  Optimized for Arabidopsis thaliana
atgaatattaagatctttaaattcattgatatctatactaacggaatcttcgttgaattcaataacaaggagaacaaacttttgtctatcaatcttttgcttaacgatgaaattatcgagaagacagaaactacaggagaatctcatttgttttctatcgataagtctggtcattacagagttgagatctctcttgaagctgagaatactgctaacatccaatctaaggaaatctatttccatatctctgaaggagagagaaaaaacaagattaaaactacaactaaggagaagacaatcaatcaaaagattgctggtatctctaactattacttggatatcaaagctaagaaaaagaattacgataagattaaacaggatttgacattttactctaagcttccaactttggaacttaagagatctttgatctatgatacacttaacgagtacgattacttcactttccatggagatggaaagtttgagattttggttgagcttgctgaacagatcgagtctcttgattatgttgaatactgttctgttactccagatacaactggatacttggctcctgaacttccagttaaccctgagcaattggatgatattaaatctgagtctgatgatttcatcactccagatttcacacctagacagacttatcttgatgctcctaagggtatgaatattagagatgcttgggctaaaaatatcaacggatcttctgctgttgttagacatttggattttggtgtttacagaaaccatgaagatcttatcgattctaacatcgttgttgttaactctagacctgaatctgaggattgtaatcatggaactgcttctacaggttgtattgttgctacattgaacaagtttggagttactggtatcgctcatcattgtcaattctacttctacgatacaggagatttggatcttatcgttaaccatgttcaaccaggagatattgtttctcttgatatccagttctctgttggaggtaaattgcttcctgctacagctattagatcttggtgggagaggatgaagattattgttgataaaggagctactgttatcttggctgctggtaacggaggtttggatctttctgaaccaggagttatgcaagattttggagattctggttctattcttgttggagcttgtaatcatcagaacggtactagagcttatttttctaattacaaccctgaagttgctttcgttaattcttggggagattggtctgttacaactacaggatatggttctttgcaaaagcttccaggtaataacagaaactactctaataactactctggaacatcttctgctactcctttgtgttctggtgctttggctcttatccaagattacgctaaaaagcagggtgctattctttctccatggcagatgagaacagttatcgctgcttctaattatactgagggagtttctcatggaattggttgtagaccaaacgttgattacttgttcggtatcgttgattctattatcagaaaatctgatcttcctgaatctgctcaccaccaccaccaccactaataa

SEQ ID NO: 1094 - DNA, 1581 bp, Artificial sequence; identical to SEQ ID NO: 1093
  Optimized for Arabidopsis thaliana

SEQ ID NO: 1095 - DNA, 1641 bp, Artificial sequence
  Optimized for Glycine max
ccatggtttaggtctctctatctacatataaatacacaaaaaattccattatcaatgaacattaagatttttaagttcattgatatctatactaacggaatcttcgtggagttcaacaataaggaaaataagcttttgtctattaaccttttgcttaacgatgagattattgaaaagactgagactacaggagagtctcatttgttttcaattgataagtctggtcactatagagttgaaatttctcttgaggctgaaaacacagcaaacatccaatctaaggagatctatttccatatttcagagggagaaaggaagaataagattaagaccactacaaaggaaaagaccattaaccaaaagatcgctggtatctctaactactacttggatattaaggctaagaagaagaactacgataagattaagcaggatttgaccttttactctaagcttcctactttggagcttaagagatcattgatctatgatactcttaacgagtacgattacttcacattccacggagatggaaagtttgaaattttggtggaacttgctgagcagattgaatctcttgattatgtggagtactgttcagttactcctgataccactggatacttggcaccagagcttcctgttaacccagaacaattggatgatattaagtctgaatcagatgatttcatcactcctgatttcacaccaagacagacctatcttgatgctccaaagggtatgaacattagggatgcttgggcaaagaacattaacggatcttctgcagttgtgagacatttggattttggtgtgtacaggaatcacgaggatcttatcgattctaacatcgttgtggttaactcaaggccagagtctgaagattgtaatcatggaacagcttcaaccggttgcattgtggcaacattgaataagtttggagttaccggtatcgctcatcactgtcaattctacttctacgatacaggagatttggatcttattgtgaaccacgttcaacctggagatattgtgtctcttgatattcagttctcagttggaggaaagcttcttccagctacagcaattagatcttggtgggaaaggatgaagattattgtggataagggagctaccgttattttggctgctggtaacggaggattggatctttcagagcctggagtgatgcaagattttggagattctggttcaattcttgttggagcttgcaaccatcagaatggtactagagcatatttttctaactacaatccagaggtggctttcgttaactcatggggagattggtctgttacaaccactggatatggttcattgcaaaagcttcctggtaacaataggaactactcaaacaattactctggaacttcttcagcaacaccattgtgttctggtgctttggcacttattcaagattacgctaagaagcagggtgcaattctttcaccttggcagatgagaaccgtgattgctgcatctaactatactgaaggagtttcacacggaattggttgcagacctaatgtggattacttgttcggtatcgttgattcaattattaggaagtctgatcttccagagtcagctcatcaccatcaccatcactgataagagctc

SEQ ID NO: 1096 - DNA, 1854 bp, Artificial sequence
  Optimized for Glycine max
ccatggtttaggtctctctatctacatataaatacacaaaaaattccattatcaatggcttcttcaatgttgtcttcagctgcagttgtgacatctcctgctcaagcaactatggttgcaccattcactggacttaagtcttcagctgcattccctgttacaagaaagaccaacaaggatattacttctattgcttcaaacggaggaagggtgtcttgtatgaaggtttggccacctattggaaagaagaagtttgaaactttgtcatacaacattaagatttttaagttcattgatatctatacaaacggtatcttcgtggagttcaacaataaggaaaataagcttttgtctattaaccttttgcttaacgatgagattattgaaaagacagagactacaggagagtctcatttgttttcaattgataagtctggtcactatagagttgaaatttctcttgaggctgaaaacaccgcaaacatccaatctaaggagatctatttccatatttcagagggagaaaggaagaataagattaagaccactacaaaggagaagactattaaccaaaagatcgctggtatctctaactactacttggatattaaggctaagaagaagaactacgataagattaagcaggatttgacattctactctaagcttcctaccttggagcttaagagatcattgatctatgatacccttaacgagtatgattactttactttccacggagatggaaagtttgaaattttggtggaacttgctgagcagattgaatctcttgattatgtggagtactgctcagttacacctgataccactggatacttggcaccagagcttcctgttaacccagaacaattggatgatattaagtctgaatcagatgatttcatcacccctgatttcactccaagacagacatatcttgatgctccaaagggtatgaacattagggatgcttgggcaaagaacattaacggatcttctgcagttgtgagacatttggatttcggtgtttacaggaatcacgaggatcttatcgattctaacatcgttgtggttaactcaaggccagagtctgaagattgtaatcatggaactgcttcaacaggttgcattgtggcaactttgaataagtttggagttacaggtattgctcatcactgtcagttttatttctacgataccggagatttggatcttattgtgaaccacgttcaacctggagatattgtgtctcttgatattcagttctcagttggaggaaagcttcttccagctaccgcaattagatcttggtgggaaaggatgaagattattgtggataagggagctactgttattttggctgctggtaacggaggattggatctttcagagcctggagtgatgcaagattttggagattctggttcaattcttgttggagcttgcaaccatcagaatggtacaagagcatatttttctaactacaatccagaagtggctttcgttaactcatggggagattggtctgttacaaccactggatatggttcattgcaaaagcttcctggtaacaataggaactactcaaacaattactctggaacctcttcagcaactccattgtgttctggtgctttggcacttattcaagattacgctaagaagcagggtgcaattctttcaccttggcagatgagaacagtgattgctgcatctaactataccgaaggagtttcacacggaattggttgcagacctaatgtggattacttgttcggtatcgttgattcaattattaggaagtctgatcttccagagtcagctcatcaccatcaccatcactgataagagctc

SEQ ID NO: 1097 - DNA, 2082 bp, Artificial sequence
  Optimized for Arabidopsis thaliana
atgcaaattacttacttggatgatcttcctacattgggatctaatgcttttcaattcgaaggaactcagtctggagattctacagaaagatttcttgctgagtacggtcagaatgctgctaacttcgtttctgaagagaagaaacaaaagaaattggctgatatggctcaggattatgctagacataaagctgctaatattgctactgatgaaatcacacaatggctttctaaggctggaaacactagacttaacattaatttgaacgagaagctttctatcaagacatctcagcttgattggttggttccatggtacgatcaacatgattttcttttgttctctcagcattctatccatagaactgatggaagattgcaatctaataacggaattggtcttagacattttcatcagaattctatggttggtatcaacgctttctttgatcatgatctttctcattaccattctagacttggattgggtcttgagtatgctcaagattacgctagagtttctactaactcttacttgggtctttctacatggagatctgcttctgaattggcttacaactactacgttagacctgctaacggatgggatattcagttggagggttggcttccagcttattctaatcttggagctaacttgaaacttgaacaatattacggagatgatgttgctttgtttggtactaatgagagacagaagaaccctatggctgctacagttggtgttaattggtctcctttcccacttttggctcttaacgttgaacatagaatcggaaataacggtgctaatgagactggagctaaaattgcttttaactggcttttgggtagatctttggaacaacatcttgatacatctgttattgaggctaatagacatatccctaataacagatacgatttcgttaacagaaataacaatatcgttttggaataccaaaagaaaactcttatttctttgtctcttccaaaggttatccagggagttacaggtgaagagagatctattatcagaaatcttactacaaagtaccctatcgaaaagatcgttgttgatgctccagagttgattgctgctggaggtagattgcatcttaacggaatcgattcttctgttaaattgccttcttataagatcacaaacaatgctcttaagaaccaacagttgaacctttacagattgactgttacagtttacgatactaagggtaatgtttctccacaagttgaaacattgattgaggttactggaacaggtgctcttactatcacacatgagaacactaagaaaagaaataacggaatcgctgatggtaaagatgctaacacattcgctatcgttatcaaggatcctcttggacatcctgttccaaatgctaaagttaacttcgttttgccagctaaccttagatctatcgatcaaaagaatactggttactactctcttttgaaccatttcatgtggaaggctaaagctaagaaagctgtttctgaacaaaagtacaacatcatcgctaacgataagggagaggcttctattcagtttactacattcatctctggatcttatgttgttaaagctaacacagaatacggtcctgaaattaacgagatgtaccatttcaagccagatatctctcaatctttcatttcttctatcgatatcatcagaaacaatgttgctgctgatggaatctctaagaataagattaagcttagaattatcaacaattctagacagtctattgctggagctttggttcattttgaggcttctaatggtattatctctcctgctaaccttactgatgaatacggtaacacagaattggagatctcttctcttgttgagggatctatcgatattatcgctactcttaacggagattctagaacaatccaagttaactttttgaagtacgctcctacttcttacatccagccatctacagaatctttgttcaagccatctattaatgagcaaaacagacatacttctttgtctcttttgagagaacttttccagaaaatcggtcaccaccaccaccaccactaataa

SEQ ID NO: 1098 - DNA, 2082 bp, Artificial sequence; identical to SEQ ID NO: 1097
  Optimized for Arabidopsis thaliana

SEQ ID NO: 1099 - DNA, 2169 bp, Artificial sequence
  Optimized for Arabidopsis thaliana
atggaaagaccttcttacgctggtgctgcttctgataagccatcttatactacagaacaagctgctgagcagatcactagaacaggttacagatggaaagagagaaatcctgatggaactacaccaatttcttacagatttttcactccttctcaagctacttataatacaccagctggagctaacgaattttctaagcatcaaaaagagcaggctagaagagctttgcagtcttgggctgatgttgctaatatctctttcactgaaaatgctcctgatgctaacggtcatcttattttgggaaacgatcctcaaacaggtcttgctggatatgcttcttacccaggtgtttataataacggaactcaggcttggtttgcttctggaggttctaattactttttcacacatggttctgtttctagatatgttttggctcatgagattggtcatactcttggattgatgcatcctggaaagtataataacggaggttcttacgctgaaaacgctagatatgctgaggatacaagagcttattctcttatgtcttactggtgggctggtcatttgggacatgatcataataagaacggtcaaacacattacgcttctgctccacttatggatgatattactgctatccagaagttgtatggagctaactacaaaacaagaaacactgatacagtttacggttttaattctaacactggaagagatttcctttctttggattctcctgatgatgctccagtttttaatgtttgggatggaggtggaaacgatacacttgatttttctagattccatcaagctcagactatcaaccttaaggctgaacatttctctgatgttggtggattgaagggtaatgtttctattgctaaaggagttacacttgagaacgctatcggtggaactggtgctgatagattgattggaaatcatgctgataacagattgactggtggacttggtcaagatatcttgacaggtggacctggaaaggatactttcgtttacaataacgcttctgaatctacagagcagagaccagatagaatcactgatttcacatctggtgaagatagaattgatgtttctgctgctcttagagctgctggattgaaggatcttcatttcgttagaagattctctggtagacctggagaggctcttttgggttatgatccaagatctggacatcattctttggctattgatcttaatggtgctggacaagctgatctttttattaagtctcagggtcctatcaaaccaggagatgttatttctcaagcttctcatgcttctactgctcctacaagaccattccaagttactcctcagcctccaactccagctaagacagctccttacgaaccaagaagagagacaatggctttgcctcaacaggctccattctctcttcaaaatcatgctaacgctactttgaaaggtacacctatgcatactgctgctagagctgttggatctatcagagaagtttctgtttctagagattcttggggatatgagagagttcatacaagatctttgggtactggatctcttattaatgatggtaactctgttcttactaaccaacatgttagagatgctttggctaagggatctaaacttgaattgtggcttggttacgagcaggattctgctggaaggatgaaggttgaaagaaaagttcctttggctcctacaccactttctggagatgctagacttgattatgctgagttgcctgttgatcttccagctggagaaaagaaagctttggctgagcaatttcctccattgaagcttgctcctggtccacaagcttctcttggacagaaagtttttatgccaaatcatggtcaagaagctttgggaatctctttccttaacgctaagggtcagcctactacattgaaaggttacgatcaaggatctccatatcagggaactgtttaccatgatgctttcaagaaacctggtacatctggatctccacttatctctgttgatactggagagattgttgctttgcataacggatctatttctgctaatgttaacggtcatagagcttctatgggaactgctacaagaattgatcttatccaacagcatagaagaaaaagacaccaccaccaccaccactaataa

SEQ ID NO: 1100 - DNA, 2169 bp, Artificial sequence; identical to SEQ ID NO: 1099
  Optimized for Arabidopsis thaliana

SEQ ID NO: 1101 - DNA, 2967 bp, Artificial sequence
  Optimized for Arabidopsis thaliana
atgattgagcatcctttttctcttttgagaaatcttgctagaacaggaaacgatactcatgaacatggagatgagacactttctttcatcaatgctatggaaaagttgaacatccattctgttttcgatatcgttagaagatctaaatctgctttcgttcatgagctttctagaatttctgatgctggagctgctttggcttatgaaaacgctagatgttacgctacacagatcgttagactttacagaaaccaacttttgtcttctggaagaactcaacagcttacacagagaactggtgttagatctttggttgatattggacctggttttccaaatcttttcaaggagaactgggatttgttttgtaaggttggagctatcgaagctaaagattctcctgttgcttatttgacatctctttacagattcgctttggaacaacttgagggttctgttgctgagccttctagaattaagcttgatgaaagaagaccagatttgaaagatcttttgatcgatcatcagtctacttttacacctgttccaactcttcatatcgttaaccaagttttgtctaaggctatcaacgcttatgttggaacagttccagaggataagggaaagactatctatcaacttgttgctgaaaaacaacatccttttcagttcccatacaacttccatttccaacagatctctttgggacttgatggaaagaagcctactttgggagagctttcttacagagtttctcttgaagttccaactacatctagatatggatctgattacggtaaagttcagcattcttctgctattgctcaagttttgatgtctggagctggtcctgagcaacaggctatcgttcttgaaccagctttgtcttctcaggctaacgctgatacatctgctgatcttactagacaatttttcaagacaaagtacaacgttgattacgttgatgatgcttctaatcctttgaataaccttaacgcttttcttgagaagacaggattggattctgatggtgttgaagctcttttggctattggaaatcatactgcttatgcttctcctaacatcctttctgctggtcatactacagatgaagattctccaagagaggcttctttgactgctattaaagctagattcggagctggttatgttaacggacctactacacaaccagctatggctcttaacaaggatgcttacggtatcaaaagattggttaacacatctgttgatagattcgatagacttcagagaatgatcagattgcaaagatggactggaatccctttcacagctttggatactcttgttatggctgttgttagatctgagggtgctgttaatccacagatggttcttacagttaacactttgagagctcttggaacttatagataccttaacaagagatacggtttggctccagatgagtttgctgctttcgttcatcaaatgcctggagaagctaatgatggtagacttccaatgttcgatagagttttcaataaccctgctttgtttgatacaccattggttcttgatggatctactttgtaccttgatcaacattcttctcagcatgttaaagctagagctcagctttctagagctttgcatctttcttctacacatgagggattgagacaacttgctattgatgttagagaattgatcggtaatgctcctactgatttcagattgaacctttctatgatctcttctctttacagacaagctagaatcgcttctatgtttggtttgactacagctgaatgtagagctcttattgatcttttgggatctttgtctttcagaaagaaagttgtttctggtcagcttgatgatacagagccagatgttttggatatccttatgcaattggattgggctgttacttggcttgaagcttctgatagagatgttactacattgagaagacaggctggatgggatatgactgaaacaattgttacacaagagcttactgttcaacttgaacagttgacaaacgatgctagacttgctgttttgaagggagatcagcttgcttctttggatcttccttctaaggatgatcaaaataacactttgaattggtgggctatcctttactaccatttgatcgatggatttggtcttgttactacacagcctttggatgaagagccagctgtttctattagaagaacacttcatgagagattgtcttctattgctatcgctgaacctcttgcttctgaagttgaggctagacttgctacttttgttttgaacggatatagaaaccaacatagattggttgaagagcttttgcttactcttacaggattgcctccagatagatgtgagccagttattagatgggctggttctgatgtttctaagttccttgctgctttgctttgggataacggagttattgagacactttctatgttgatcagatactctgaagtttctcaacagttgggtctttctgctagagctcttagaacttttcttattaatcctagatggctttatgctggatctgagggacagttctacctttctccaaactctttgtatttgcttgatagatactctaattggagagataactgtggttatcctgaagaggctttgcttgaatacttcaagcaagctaacgatccacagagagatgctacacaatgtgctgctagacttgcttctttgacaggatggacttcttctgaggttcttgctgctaatgctttgcttactggttctgatagaattgcttcttctatgcatgaagttgattggttgtctagaatgcattctgcttctgatgttacaggactttctgctagacaattgctttctgctactgatttgactgctacatctactgcttctcattggaaatctgttggtgaagctgttatcgctgctaatagacaccaccaccaccaccactaataa

SEQ ID NO: 1102 - DNA, 2967 bp, Artificial sequence; identical to SEQ ID NO: 1101
  Optimized for Arabidopsis thaliana

SEQ ID NO: 1103 - DNA, 2802 bp, Artificial sequence
  Optimized for Arabidopsis thaliana
atggttgagagatctaacgctttgcatcagcatactcctgctcttcaattggttgatcctagaggattgccagttggttctattgctctttgtagaacatcttctgatattgaaccacaaatccttacttctcatgcttcttttgatatggctggaagacctgtttcttgttgggattctagattgtgggctgatagagctccagctaatctttctgttatccattctttgtctggacaggttcttgcttctgattctgttgatgctggttggagagtttctttggctggagaggctggtcaagctcttgttgtttgggatgctagaggagttgttagaagaattggttacgatgctcttttgagacctatcgaggtttttgaggatgaacattgtgttgaaagacttttgtatggaggtcctgattctacagatcataaccaatgtggacagcttattagacatgatgatccagctggtacaagattggatgatgcttatggactttctggtaatgttatcagacagactagaagattcttgcattctgctgatgagcctgattggccagaatctcttactggaagagatgctcttttggagcctggagatggtgctactacatgttggcaatacaacccactttctgaaattacatggcaaagagatgctcagggtaatgttcaatgtttgggatatactgttgctggtcagcttaaggattctagacttcaattgaacggacaagctgagcaggttttggtttctgctattcagtacgatgctcaaggtagagttgtttctgaaacagctggaaatggtgttatctctactgctctttatgctgctgaggatggaagattgggtgaacttaacactacaagatctaacggacaatctttgcaggatcttagatacgattatgatcctgttggtaacgttattagagttgatgatagagctcttccagctatttctaaaggacagagaatcgattctgtttctacatacagatacgatactttgtaccaacttatcgaggcttctggtagagaatgggctgttgttaaccatggacctgttttgccaggtttccagtctcctgctgatccatctactcttgctgattacactcaaacatacagatatgatgctggaggtaatttgcaacagcttactcatacaggaactcaatctcattctagaacattggttactgctagattttctaacagatctcttcctgttattaatggtcatatcccagatgaggctgaaattgctgctgctttcgatgctaacggaaatcttttggctttgcaagctggtcagaacctttcttgggatagaagaaatcaattgcagcatgttagacctgttatcagagagaatggtatggatgattctgaaagatactcttatgatgcttctggtcagagacttagaaaggttagaactacacaagctaaaacaatcactcatacagctgatgttagatatttgcctggacttgagatcagaactgatacagctactggtgaaacacttcatgttgttgttgctcaggctggaagaaataacgttagagttttgcattgggcttctggaaagccagatgctcttgagaacgatcaaacaagatacactttgaatgatcatcttggatctggtacacttgagttggatggacaagctcagagagtttctcatgaaagatattacccttttggaggtacttcttggtgggctggaagaaatgctattgaggcttcttacaagacagttagatattctggtaaagaaagagatgctactggattgtattactatggtcttagatactatgctccttggttgcaaagatggatcaaccctgatccagctggacttgaagatggtcttaatttgtacggaatgttgagaaataacccacttactttcattgatgctgttggaggtgttgctgagatccctaaacatattcattatatctggttgggagctgctgaaccattgatggagcatcttgaaggtattaagaacacatctgttcttaatccagattaccagcttactttgcatcttcatttggatcttagaaaaggagatgagacagaaattgcttctgctttgagaggtagaagaaacgttcatatctctgatcttagagaagaggaatttttcagaaagtttcaaaagactccttcttacgaaatctataaggatctttacggagatgatccaagacattattctgctgcttctgatgttttgagatactctcttattaaccattacggaggtatctattctgatacagatgatatgttcaagagaggtgttagagatacagatttcatcactaagcctaagagaatcttcactatgagacctacagatactccatggaacagagatgagatcgttatcaataacaattctttcgcttctcctgctaacaatccagttttgtctacacttgagaaggaaatcgttgatagatactctgtttacagagaaacaggattgggaaaggttctttcttctactgctgatgtttctgatagaatgagaatcgtttctgctgttacaggaccaaaggtttttactgaggttcttttgaaggaaggaagaggtttgagaaaacttttctctactatggttaactaccatgttaagggagagaagttgaagaaccctaagagataccaggctgaagctcaaaagagaatgccactttctaacttcattaaaatgggaggttctcattcttggcaacaccaccaccaccaccactaataa

SEQ ID NO: 1104 - DNA, 2802 bp, Artificial sequence; identical to SEQ ID NO: 1103
  Optimized for Arabidopsis thaliana

SEQ ID NO: 1105 - DNA, 1281 bp, Artificial sequence
  Optimized for Arabidopsis thaliana
atgcaaactgaaaacgttcttgatatcagaacaatcgttgctaacgaatacgctgttaagacttctgctttggagtgggatgttacagatatcgttaaaaacgctattatcggaggtatctcttttatcccttctgttggaccagctatttcttttcttgttggtttgttctggcctcaatctaaggaaaacatttgggagggaatcgttaaacagattgaaagaatgatcgaagagtctgctcttaagactattaaaggaatcttggctggagatattgcttacatccaagagagaatggctacagttgctgatcttttggaaaagcatcctggatctgctgaggctagaaacgcttttaataaccttgctgaaaacatcgatggttaccataagaagtttaataacttctctgatgatgttaactaccaaatcttgccaatgttctctactacagttatgatgcagattacttattgggttgctggacttgagagaaaggaagagatcggtttgtctgatatcgatatcgaaaaagttagaggtcttgttaagaaaacagttgagcaggctaactcttatattaataacatctacgatagagaacttaacgatgctttgaataactctactgctgatacagttgttaataacgttatgtctgttcatggacattgtagacttcatggtatcgagtacatttctatctgggatagattgtctgaaactgagtctgttaataacagaatctatgttgatgttctttcttactctactttctttgatagacaaacagctaaggctagaatccaggctttgactcctgaaaaggatatgacacctccacttaaaccagctttgaacggaggaaagagaagaaaaattaactctttgatgggacatatcgttagaatcggaggtgctccaagagttggaggtcttactgttgtttttgatgatggttctagacatcagttgggaactatttctggtgaaacagcttctatctctcttgattcttctagaattacatctttggaggtttggggaaacggtgctgttgataaggctgtttttactctttctgatggaagatctttgtctttcggagaacctggtacatctagatatagaaaattctacgttggagagtctcattatatttctggtatctacctttcttctgattattctccattggttggtcaagctgctaacatcgctgtttcttaccagcttattaacgatgatgagaaacaccaccaccaccaccactaataa

SEQ ID NO: 1106 - DNA, 1341 bp, Artificial sequence
  Optimized for Glycine max
ccatggtttaggtctctctatctacatataaatacacaaaaaattccattatcaatgcaaacagagaacgttcttgatattagaaccattgtggctaatgagtacgcagttaagacttctgctttggaatgggatgttacagatattgtgaagaacgcaattattggaggtatctcttttattccatcagtgggacctgctatttcttttcttgttggtttgttctggccacaatcaaaggagaatatttgggaaggaattgtgaagcagattgagaggatgattgaggaatctgctcttaagacaattaagggaattttggctggagatattgcatacattcaagaaagaatggctaccgttgcagatcttttggagaagcatccaggatcagctgaagcaaggaacgcttttaacaatcttgcagagaatattgatggttaccacaagaagtttaacaatttctctgatgatgtgaactaccaaatcttgcctatgttctcaactacagtgatgatgcagattacttattgggttgctggacttgaaagaaaggaggaaatcggtttgtctgatatcgatatcgagaaggttaggggtcttgtgaagaagacagttgaacaggcaaactcatatattaacaatatctatgatagagagcttaatgatgctttgaacaattctaccgcagatactgttgtgaacaatgttatgtcagtgcatggacactgtaggcttcatggtatcgaatacatctctatctgggatagattgtctgagacagaatcagttaacaataggatctatgttgatgtgctttcttactctactttctttgatagacaaacagctaaggcaaggattcaggctttgaccccagagaaggatatgactccacctcttaagcctgcattgaacggaggaaagagaaggaagattaattctttgatgggacatattgtgagaattggaggtgctcctagggttggaggtcttaccgttgtgtttgatgatggttctagacaccagttgggaacaatttcaggagagaccgcatctatttcacttgattcttcaaggattacttcattggaagtgtggggaaatggtgctgtggataaggcagtttttaccctttctgatggaagatctttgtcattcggagagccaggtacttcaagatataggaagttctacgttggagaatctcactacatctcaggtatctatctttcttctgattactctcctttggtgggtcaagctgcaaacatcgctgtttcataccagcttattaatgatgatgaaaagcatcaccatcaccatcactgataagagctc

SEQ ID NO: 1107 - DNA, 1341 bp, Artificial sequence; identical to SEQ ID NO: 1106
  Optimized for Glycine max

SEQ ID NO: 1108 - DNA, 1355 bp, Artificial sequence
  Optimized for Zea mays
ggatccacaggacgacccaagcaagcaagcaagcagcgagtacatacatactaggcagccaggcagccatgcagaccgagaacgtgctcgacatccgcacgatcgtcgccaacgagtacgcggtgaagacctccgccctggagtgggacgtgacggacatcgtcaagaacgcgatcatcggtggcatctccttcatcccctcggtgggcccggctatctccttcctcgtgggcctgttctggccgcagagcaaggagaacatctgggagggcatcgtcaagcagatcgagaggatgatcgaggagtccgcgctcaagaccatcaagggcatcctggccggcgacatcgcgtacatccaggagaggatggctaccgtggccgacctcctggagaagcaccccggcagcgcggaggccaggaacgccttcaacaacctcgcggagaacatcgacggctaccacaagaagttcaacaacttctccgacgacgtcaactaccagatcctgcccatgttcagcaccacggtcatgatgcagatcacgtactgggtggcgggcctggagaggaaggaggagatcggcctgtccgacatcgacatcgagaaggtgaggggcctcgtcaagaagacggtggagcaggcgaacagctacatcaacaacatctacgaccgcgagctgaacgacgccctgaacaactccaccgcggacacggtggtcaacaacgtgatgtcggtccacggccactgcaggctccacggcatcgagtacatcagcatctgggaccgcctgtccgagaccgagagcgtgaacaacaggatctacgtggacgtcctctcctacagcaccttcttcgacaggcagaccgctaaggcccgcatccaggctctgaccccggagaaggacatgacgccgcccctcaagccggccctgaacggcggcaagcgcaggaagatcaactccctgatgggccacatcgtccgcatcggcggcgcccccagggtgggcggcctcacggtggtcttcgacgacggctccaggcaccagctcggcaccatctcgggcgagaccgcctccatcagcctcgactccagcaggatcacctccctggaggtctggggcaacggcgctgtggacaaggccgtgttcaccctctcggacggcaggtccctgagcttcggcgagcccggcacgagccgctacaggaagttctacgtgggcgagtcccactacatcagcggcatctacctctccagcgactactccccgctcgtgggccaggctgccaacatcgccgtgagctaccagctcatcaacgacgacgagaagcaccaccaccaccaccactgatgagagctc

SEQ ID NO: 1109 - DNA, 1355 bp, Artificial sequence; identical to SEQ ID NO: 1108
  Optimized for Zea mays

SEQ ID NO: 1110 - DNA, 423 bp, Artificial sequence
  Optimized for Arabidopsis thaliana
atgtctagaatcactatctttattgattctgatgaacaaaagtctgaggtttactctaactctacagttcctgttagaaaagaacttaacactgtttttcctctttctgagttgacaatctctccaggatcttctgttgaagttttcagaatcgatactcctattatcccagagtctagaagatctcttagagttgttaatactggattggcttctcatgttactgctaagttctactggtctcattcttttacatctgaatggttcgagtctggttctatcgatgttggacttggtgaagataaagttttgaacgttccaaataactctttctactactctaagttcgttatctataataactctgataaggttgcttacattactgctaacttggttcaccaccaccaccaccactaataa

SEQ ID NO: 1111 - DNA, 483 bp, Artificial sequence
  Optimized for Glycine max
ccatggtttaggtctctctatctacatataaatacacaaaaaattccattatcaatgtctagaatcacaattttcattgattctgatgagcaaaagtcagaagtgtattctaactcaaccgttccagtgaggaaggagcttaataccgtttttccactttctgaattgactatttcacctggatcttcagttgaggtgttcagaattgatactccaattattcctgaatctagaaggtcacttagggttgtgaacactggattggcttctcatgtgacagcaaagttctactggtctcactcttttacttcagagtggttcgaatctggttcaattgatgttggacttggagaggataaggttttgaacgtgcctaacaattctttctactactcaaagttcgttatctataacaattcagataaggtggcttacattactgcaaatttggttcatcaccatcaccatcactgataagagctc

SEQ ID NO: 1112 - DNA, 483 bp, Artificial sequence; identical to SEQ ID NO: 1111
  Optimized for Glycine max

SEQ ID NO: 1113 - DNA, 497 bp, Artificial sequence
  Optimized for Zea mays
ggatccacaggacgacccaagcaagcaagcaagcagcgagtacatacatactaggcagccaggcagccatgtcccgcatcaccatcttcatcgactccgacgagcagaagagcgaggtctactccaacagcacggtgccggtcaggaaggagctgaacaccgtgttccccctctcggagctgaccatctccccaggctccagcgtggaggtcttccgcatcgacacgccgatcatcccggagtccaggaggagcctccgggtggtgaacacgggcctggcttcccacgtcaccgcgaagttctactggtcccacagcttcacgagcgagtggttcgagtcgggcagcatcgacgtgggcctgggcgaggacaaggtgctgaacgtccccaacaactccttctactacagcaagttcgtgatctacaacaacagcgacaaggtcgcctacatcaccgcgaacctggtgcaccaccaccaccaccactgatgagagctc

SEQ ID NO: 1114 - DNA, 497 bp, Artificial sequence; identical to SEQ ID NO: 1113
  Optimized for Zea mays

SEQ ID NO: 1115 - DNA, 1386 bp, Artificial sequence
  Optimized for Arabidopsis thaliana
atgcaacagcctaaagtttggtctgaatatggaattgagggttgtatctattacgaggataagtacggatacctttctttgaagactgatggtaatccttctgagcataactggtactttccatctgatggaacatctaataacagatgggatttcatccagtggagagctggtatcttcactgatccaaaacagtggggagattctggtgctaagggagatatctattactctaaggaatatctttctttctttatcttgcaaaagaacggaaacccttctgagcataattggtacttcccatctgatggtacatctaataacaggtgggattttattcagtggagagctggaatcttcactgatcctaagcaatggggagattctggagcaaaaggagatatctattattcaaaagagtatctttctttctttattttgcaaaagaatggtaacccatcagagcataattggtactttccaacagatggaaatgataacgctcagtggattgttaaaggaaacatcaagaaacaggagtggattaagtatatcaatgatgagagacctattaaccagatctctcttccaggaacacatgattctgctacttatacaattggttctgctgctatcgtttcttcttacgctaagactcaagatgattctatcttcgaacagttggagtctggaattagattcatcgatgctagatgtagacatatctctgatgtttttgctatgcataacggaaacatctatcttaatatcaacttcggtacaatccttaacgattgttacagatttttggaacaacatccagatgagttcatcttgatgtctgttaagaaagaacatactgaagagaataacacaagatctttcgataagactttcgagattaaatactacgattcttctagatggttcgttgaagatagaattcctaagcttaaagaggttagaggaaagatcgttcttttgagaagattttctggaggttctttgggtgttaatgctgcttcttggccagataaccagactttcaatacagaaaacaaaatccatgttcaagatgaatacaatcagcataacgaggctaagaaatggcatgctattaagaatgcttgggattttggagttgataactctaagaaaggttggcttgttttgaactttacttctattgctgctgatactttcacatctatcagatcttatgctcttgataagaaccctgaaatggctaagtacatctctggtacaaaggctaacggaggtgttgttatctctgatttcccaaagattggaaaaatcgctgagaacgttattatcactaacttcggtgaagttgagaagttccaccaccaccaccaccactaataa

SEQ ID NO: 1116 - DNA, 1386 bp, Artificial sequence; identical to SEQ ID NO: 1115
  Optimized for Arabidopsis thaliana

SEQ ID NO: 1117 - DNA, 2940 bp, Artificial sequence
  Optimized for Arabidopsis thaliana
atgattgagaattctatggaacttccttctacttctgagcttcctgatccattggcttctaagatggaaacaaaagctcctatcttttctttcgaagagaaccaggagccacaaatggctaataagcaatttcagcttgttgttagatcttctcaggatgtttctgaattcgttcttaacttgccagagggagtttctattttggaagataagcaatctactgatattaagtttaaaaacatcgaaggtaatcaatggcaggttcaaacagattctcctcagatgactttctctatcccacttgttggagagaaggctggtgcttatgagatcgctgttggagaatctaaaacaatgttgaacatccaaccagaagagtctcctcagactacagagcaagaaattatctcttctgaagagaatgagacagaaaagactggagaatctactgttgaagaggaagctaacggagatagagaggaaccttcttctactacagatacatctcagaacgatccagagcaagttacagaaaatgctagacttactaaagaggctagagttcaagatgttactaactgggaggaattcattcaggctttctctgatcaaacaatctctactatcgagatctctaacgattttgaagttcctactacaccattggctaatcaaacaggacttttgactggtaataactctaacgtttctggttctgctactttcgtttaccttattaagtcttctatctctagaactttgactattaacggaaacggtcatcaaattgattttggatctgtttctcttggaatgtatcctgctactcataatgagaactctccatggaacatcacattcaatgatcttgatgtttactctggaaactggtggggatttttccagactacaaatttgactgttgctcaacattctgtttctaacatcacacttaataacatcacttcttatggaaacgagttgatcgctccttattacacaaacgttgatatctctggtgttgttaataaccatatcactgaaacatacacttctaagtttagaacaaactggagagttaacactgttaactctgttaatcttgagacaagatctttgactattaaagagaacgctgaacttaatttgtcttctgttaactctggaaatttgattatcggtcttggaggtttggatgctaatcttactttggagaaaaacgctagaattaatatcgaatctaacggagcttctgctggagataatgctaacggaagaggttcttctattgatatcgttaacggaaaccttatcatgaacgaaggttctacaattaatgttatgactacaagaaacttctctgctcttaacttgagatctgctaattctttggttaagatcgatgatggatctaaaattaatatcaactctatctctcatacttgggcttctaacgctgctcatagaaatcttgtttatatggctacaggttcttctttgtctgttggagaggaatctgagtttaatgttgaagctacaggaagaggtactgctgcttctaacattgttcatatcgctggaaatgctaacttcgctgttgataaggatggtactcttgatattaaatctgattctacatctacttctcagtctcttttgtcttttgcttctgctggatctacatttcaattctctgatgctaagagagttaatcttgagagaacaggaactatcgctggtacttctactacaaatggtttgattaacatcgctggatctacaggtcttttggatattgatgttcagtctgttaaacaatgggctagaggaaactttgaggaaacaccagatcattcttggactcctattttcaatcttaacttgagatacacaggtgttgttcctagaatcgagactgtttcttctattgctcaggaaacagctgattcttttaagcaatacttcactacacagaacgttcaaagaatccttttcgagaagatcccagatgttgaagttacaatcgatccattgactgaggatcctaacgaagttaattctcatacaatcactggaaaggctaatcctaactctgttattagattctctggagatcctgctattccagctggttctatcacttctccagatatctctgagtctgaaaagtaccatactacagctgatgaaaacggagattatagatacgagcttcctgaagatagaagattcactgctggaaacacagttactgcttacgctttcttgaacggaaagaatgatacagcttctactatggttgaggaaaaaatcgttgttgctcctgttgatccacttgatcctgagactgaagttgagccagaaaataagccagagattcctgaagatcagggaagactttctttggatttcgtttctcagtttaacttcgaaactcaaaagatctctgtttctgatcaaacatactacgctcagcctcaaagacttttgaacgaggatggtacagttaatgagactgaggaaagaccaaactacgttcagatctctgatagaagagctgctaacgagagaaacggatggcaactttctgttactcagaatggtcaattcagaaataagtctggaaacgagttgattggttctgaaatccagcttttcaaccaagagttggttacagctcagggaggtactaaaccagaacttcaagaggaacctgttcaacagatccttccaaacactagaaaggttttgattaaagctaacggagaatctggaacaggtacttggatctatagattcggagatcaacagacagctaataagtctgttggtttgtatgttccaggaggtacaaaccctgaggctacttcttactctacaaaacttacttgggagttgtctgctgttcctgaaaaccaccaccaccaccaccactaataa

SEQ ID NO: 1118 - DNA, 2940 bp, Artificial sequence; identical to SEQ ID NO: 1117
  Optimized for Arabidopsis thaliana

SEQ ID NO: 1119 - DNA, 576 bp, Artificial sequence
  Optimized for Arabidopsis thaliana
atggcagtttacttcgtgacaggaaagctcggttctggaaagacccttagtgcagtgtacaagattagagattatttgatgaaaggtagaaaggttgctactaatcttaacatctcttttacaggaatgttcggttatagagctaagaatattaaccttgttagagttcctgataagccaactgcttttgatttggatgctatcggaagaggtaatacatcttacaacgaagatcttaacggacttttggttttggatgagtgtggtacttggttcaattcaagatcttgggctgataagtcaagacaagatcttattaattggatcgctcatgctagaaaattgggatgggatgttctttttcttgttcaatctcttcaggttgttgataagcaatcaagacttatgttcgctgaacatgttgtttactgtagaaggatggatagattgaagattccttacatccattggattcttcagattatcacattgggtcagttcagacttccaaagattcacctcgctatcgttaaatacggagattcaccaccacaccaccaccaccaccactaataa

SEQ ID NO: 1120 - DNA, 576 bp, Artificial sequence; identical to SEQ ID NO: 1119
  Optimized for Arabidopsis thaliana

SEQ ID NO: 1121 - DNA, 1488 bp, Artificial sequence
  Optimized for Arabidopsis thaliana
atgatgtctactgatcaacagtctgctcttcaaggacagcctttgaacggtgcttctgaaccaattatctctgctcaattcaagtacgagatcgattacaataacgctgctagagttgttatcactacaggacttgatcagattcctatggttggatttgttcttggtgctttggttgaaattttctggccatcttctcaacaggatgtttggtctgaaatcgaggctaaggttgagcaacttgttgatgctaagatctctgaattggtttaccaacaggttcaggagtctcttgctggtttgcataataaccttaatgagtatttgtgggctgttaagaacactaaggatcctaactacatcacacaaaagttcaacatcgctcatggacattttattcaagaacttcctcatttccagtctaaaggttatgagcttttgcttttgccattgttcgctcaattcgctaatcttcatttgtctcttttgagagatggagttatctacggtgcttcttggggatggggtgaagatgttcaaagacatcttagagaacagattgttgagactatccaacagtatgttcaatacactgatactacatacacagagggattgcaaaatacacagtctaaggctccttctaactctcattacactgaaccttttaatacagttaaccaatacatcagagagatgactcttacagttttggatttcaagactatgtggccttattacgatccaacacagtaccctaacccagttaaaatctatcttgatagagaaatctattctgatgctgttggaactgctgataactctggtcctatcacattgccatctcctccaactaaggctattacaaaaatcgaagtttgggcttgggatagaattgatggttgtcaagttacatacgagcagggaggtggacctaacggagttactcaaacaccaagaatgggagatcagggtggaggttcttcttctcctccacatggaggtgtttttgatcttgttactagaggacctgttgttggtgttaaaacactttctggatctatcttgaacgcttggtggtttactttcgatgatggttctacatctaatcaacttggaggtaattaccctggaggttctgatcattctttctcttacccagatgagatcttgtcttctattaagatcatgggagtttctaactactacaaatctgctgattgtgctgttttcggtttcaagtttaaacaagaacagtctttgcctgagccagctcttttgagaactatgtatgttgcttctcctgctaagatttctccagaagagcttgctagatgtgttggagctgaagatatcgataagactggtaaattgattcaagagtggtctgatttctaccattgggatactatcagacagtctcattgggatagaattcaaacagttgttgattctcagggaaaacaccaccaccaccaccactaataa

SEQ ID NO: 1122 - DNA, 1488 bp, Artificial sequence; identical to SEQ ID NO: 1121
  Optimized for Arabidopsis thaliana

SEQ ID NO: 1123 - DNA, 1562 bp, Artificial sequence
  Optimized for Zea mays
actagtacaggacgacccaagcaagcaagcaagcagcgagtacatacatactaggcagccaggcagccatgatgagcaccgaccagcagtcggctctccagggccagcccctgaacggcgcttcggagcccatcatctcggcccagttcaagtacgagatcgactacaacaacgcggccagggtggtcatcaccaccggcctcgaccagatccccatggtgggcttcgtcctgggcgcgctggtggagatcttctggccctccagccagcaggacgtctggtccgagatcgaggccaaggtggagcagctcgtcgacgcgaagatcagcgagctggtgtaccagcaggtccaggagtccctggcgggcctgcacaacaacctcaacgagtacctgtgggcggtcaagaacaccaaggacccgaactacatcacgcagaagttcaacatcgcccacggccacttcatccaggagctgccgcacttccagagcaagggctacgagctgctgctcctgcccctgttcgcccagttcgcgaacctccacctgtcgctgctcagggacggcgtcatctacggcgcttcctggggctggggcgaggacgtgcagcgccacctcagggagcagatcgtggagaccatccagcagtatgtgcagtacaccgacaccacgtacacggagggcctgcagaacacgcagtccaaggcgccgagcaactcccactacaccgagcccttcaacacggtgaaccagtacatcagggagatgaccctcacggtcctggacttcaagaccatgtggccgtactacgaccccacgcagtacccgaaccccgtcaagatctacctcgaccgcgagatctacagcgacgcggtgggcacggccgacaactcgggccccatcaccctgccatccccgcccaccaaggccatcacgaagatcgaagtgtgggcctgggacaggatcgacggctgccaggtcacgtacgagcagggcggcggccccaacggcgtgacccagacgcccaggatgggcgaccagggcggcggctcctcctccccgccgcacggcggcgtgttcgacctcgtcacccgcggcccggtggtcggcgtgaagacgctcagcggctccatcctgaacgcctggtggttcaccttcgacgacggcagcacgtccaaccagctcggcggcaactacccaggcggctccgaccacagcttctcctaccccgacgagatcctctcctccatcaagatcatgggcgtcagcaactactacaagtccgccgactgcgcggtgttcggcttcaagttcaagcaggagcagagcctgcccgagccggccctcctgcgcaccatgtatgtggcttcgcccgccaagatctcgccggaggagctggctcgctgcgtgggcgcggaggacatcgacaagaccggcaagctgatccaggagtggagcgacttctaccactgggacaccatccgccagtcccactgggacaggatccagacggtggtcgacagccagggcaagcaccaccaccaccaccactgatgagagctc

SEQ ID NO: 1124 - DNA, 1700 bp, Artificial sequence
  Optimized for Zea mays
actagtacaggacgacccaagcaagcaagcaagcagcgagtacatacatactaggcagccaggcagccatggcccccaccgtgatgatggcctccagcgctaccgccgtggctcccttccagggcctcaagtccacggcctccctgccggtggctaggaggtccagccggtccctgggcaacgtctccaacggcggccgcatcaggtgcatgagcaccgaccagcagtcggccctccagggccagcccctgaacggcgcctcggagcccatcatctcggctcagttcaagtacgagatcgactacaacaacgcggccagggtggtcatcaccaccggcctggaccagatccccatggtgggcttcgtcctgggcgccctggtggagatcttctggccctccagccagcaggacgtctggtccgagatcgaggcgaaggtggagcagctcgtcgacgccaagatcagcgagctggtgtaccagcaggtccaggagtccctggccggcctgcacaacaacctcaacgagtacctgtgggccgtcaagaacaccaaggacccgaactacatcacgcagaagttcaacatcgcccacggccacttcatccaggagctgccgcacttccagagcaagggctacgagctgctgctcctgcccctgttcgcgcagttcgccaacctccacctgagcctcctgcgggacggcgtcatctacggcgcctcctggggctggggcgaggacgtgcagcgccacctcagggagcagatcgtggagaccatccagcagtatgtgcagtacaccgacaccacgtacacggagggcctgcagaacacgcagtccaaggccccgagcaactcccactacaccgagcccttcaacacggtgaaccagtacatcagggagatgaccctcacggtcctggacttcaagaccatgtggccgtactacgaccccacgcagtacccgaaccccgtcaagatctacctcgaccgcgagatctacagcgacgccgtgggcacggcggacaactcgggccccatcaccctgccatccccgcccaccaaggcgatcacgaagatcgaagtgtgggcttgggacaggatcgacggctgccaggtcacgtacgagcagggcggcggccccaacggcgtgacccagacgcccaggatgggcgaccagggcggcggctcctcctccccgccgcacggcggcgtgttcgacctcgtcacccgcggcccggtggtcggcgtgaagacgctcagcggctccatcctgaacgcgtggtggttcaccttcgacgacggcagcacgtccaaccagctcggcggcaactacccaggcggctccgaccacagcttctcctaccccgacgagatcctctcctccatcaagatcatgggcgtcagcaactactacaagtccgcggactgcgccgtgttcggcttcaagttcaagcaggagcagagcctgcccgagccggctctcctgcgcaccatgtatgtggcctcgcccgctaagatctcgccggaggagctggcccgctgcgtgggcgccgaggacatcgacaagacgggcaagctgatccaggagtggagcgacttctaccactgggacaccatccgccagtcccactgggacaggatccagacggtggtcgacagccagggcaagcaccaccaccaccaccactgatgagagctc

SEQ ID NO: 1125 - DNA, 309 bp, Artificial sequence
  Optimized for Arabidopsis thaliana
atgagatatgatgattaccatgaagcttgggagatgaatcctagaaagttgtctactgaagagattgaaaacccaggaaaagttatcgaggatttctttagagtttctcatcttcctggtatgagatcttctctttgggaattgatgaagacaatggttactggaacattttctaatttgaagtctagagagagagctagacttatctatttctacgaacaagttgagaagcttatcgaagctgctcatgttttgcatgagaagaacaaaggtctttctccatctcaccaccaccaccaccactaataa

SEQ ID NO: 1126 - DNA, 309 bp, Artificial sequence; identical to SEQ ID NO: 1125
  Optimized for Arabidopsis thaliana

SEQ ID NO: 1127 - DNA, 1566 bp, Artificial sequence
  Optimized for Arabidopsis thaliana
atgaatattaagacttttaagtttattgataagtactctaacggaatcgttgttaacttcgataacagaaacaagaaaacagttactatctctcttttcttggataatgagaacattaaaacaatctctactaataacgatcattatctttttaaggttgataagtctggtaactaccatgttactatctctttcatcgattctaataagaacatccatcatttgatcgattctcctgcttcttattactttgctcaacagaagacaaagcaaaacattaagaaagagtctaagtctaaaactatcaatcataagatcgatggaatcaacaaatacttccttgaaattaagtctgagatcaaatcttctcatttgattatggatatccttccaaatgagttgatgaactctaagcttatcttgatcaaatctaacatcgaatcttctgttaagcagtacgagtaccttaatttgtacggagaagataacttcgatagacttttggaactttctcaaaagatcgagcagttggattacgtttcttactgttgtatctgtcctgatactacaggttaccttcctccaaaacttccattgaactctcaagttttggaagaggatacatcttctaatgagatcacacctaacttcacttatcttcagaagtacttggatgctccaatgggtatgaatgttagaaacgcttgggaaaagaatatcgatggatctcaagctgttgttagacatcttgatttcggtgtttataagaaccatgaggatcttaagaactctaacttgatcgttgttaactctagacctgaaactcaggattgtaaccatggaacagcttctactggttgtattatcgctacaaagaatgctttcggagttactggtatcgctcataactgtcaattctacttctacgatacagatgatcttgatcaattgactaatgatgctcagcctggagatatcgtttctcttgatatccagttttctttcggagagaaacttttgccagctacagctgttagaaactggtgggaaagaattaagatcatggttgataaaggagctactgttatccttgctgctggtaacggaggacttgatttgtctgagccaggagttatgacagattttggagataacggttctatgttggttggagcttgtaataaccaaactggttctagagcttatttctctaactacaaccagaagtcttctcttattaattcttggggagattggtctgttactacaactggatatggttctttgcaaaagtaccctggaaatgagagaaactacacaaaggattactctggtacatcttctgctactccactttgtgctggagctttggctcttttgcagggttacgctaaacaacatcagattatcctttctgcttggggaatgagagagttgattaagaaatctacatatactgaaggtgttaacgatggaatcggttacagacctaatgttaacgatcttttgaaggagattgataaacttgctcaaatcactgaacaccaccaccaccaccactaataa

SEQ ID NO: 1128 - DNA, 1566 bp, Artificial sequence; identical to SEQ ID NO: 1127
  Optimized for Arabidopsis thaliana

SEQ ID NO: 1129 - DNA, 1623 bp, Artificial sequence
  Optimized for Arabidopsis thaliana
atgcaagattctcagcatagaatggctaatgatcagaactctgttatctatgtttgtttctctaagggaattaattctgaaaaggctgctttttctagaaacgctgatcttgaaagattctctagagagaaccatatctcttttaagtacgatcttgatttcactgataacaaattggatgagatggctagaaattctaaggctatcggtaactctacagaatctgttgagaagcttaagagaatctataaggctgatcttcctttgcaatctactgaaacagctgagaagattatcagaactttggaaagattccctgaaatcgaatatgtttctgttatgtctgctgaaccagttgagcctccacttgttaatgctttcgttgctactcctgatcttgagtctttgcaaacatatttgaacgataatccaggaatcaatgctaaatacgcttggtctagaggaatcactggtcagaacattagagttagagatgttgaatatggtttctacaagacacatgagatgctttctaaccaaaattctattcagttggaacctggatattctccaaattctggtcttgctaataacaattacagagatcatggaactgctgttgtttctatccttggttctatcaaagataacattggattgactggtgctgcttactctacatctgaaatcaagggatatatggagtggactacagttggatacaatagagcttctgctgtttctagatctattaacgcttctcaagctggagatattatcctttatgaaatgcaaacaggaggtaaagatggacagtactgtcctgctgagtatgatcaggttatttgggatttgactaaggctgctacagattctggaattatcattatcgctgctgctggaaacggtaatcaaaaccttgatgatcctttctacgctaactacttggctagaggaaactctggtgctattatcgttggagctggttctccaaacactacacattctaaactttctttctctacttacggaaacagagttgatgttcagggatggggttcttctgttttggctgctggatatggttcttacgctaagtacgataacgataacaatagaacatataactacttctctggtacttcttctgctacaccagttgtttcttctgctgctattcttatccaatctttctacagacaaactacaggacagtatttgactcctgctgctatgaaaaaccttttgatctctacaggtattccacaaggaggtactgttacaggacagaagatcggtcctcttccaaatgttaaaaacgctattcttcagttggaatctaagtttgctactcctgttaaaacactttctgctttggaggttaagatctatcctaatccatcttcttcttctattgctatccaatctaatgagaacaagaaacttgatatcgagattatcaacttgcagggtagaactgttattaagtcttctgttctttctcatgagaagatcgatatctctcaattgccagctggacagtacattatcaatatcaacgaaggtcaaagaagagttgttgagaagttgacaaaaattcaccaccaccaccaccactaataa

SEQ ID NO: 1130 - DNA, 1623 bp, Artificial sequence; identical to SEQ ID NO: 1129
  Optimized for Arabidopsis thaliana

SEQ ID NO: 1131 - DNA, 1683 bp, Artificial sequence
  Optimized for Glycine max
ccatggtttaggtctctctatctacatataaatacacaaaaaattccattatcaatgcaagattctcagcatagaatggcaaacgatcagaactctgttatctatgtgtgtttctctaagggaattaactcagagaaggctgcattttctaggaatgctgatcttgagagattctctagggaaaaccacatctcttttaagtacgatcttgatttcactgataataagttggatgaaatggcaagaaactctaaggctattggtaattctacagagtcagttgaaaagcttaagaggatctataaggcagatcttccattgcaatcaactgagacagctgaaaagattattagaactttggagaggtttccagagattgaatacgtttctgtgatgtcagctgagcctgtggaaccacctcttgttaacgcattcgtggctactccagatcttgaatctttgcaaacatatttgaacgataaccctggaattaacgcaaagtacgcttggtcaaggggaattaccggtcagaatattagagttagggatgtggagtatggtttctacaagacccatgaaatgctttctaaccaaaactcaatccagttggagccaggatattctcctaactcaggtttggcaaacaataactacagagatcacggaactgctgttgtgtctatccttggttcaattaaggataacatcggattgacaggtgctgcatactctacctcagagattaagggatatatggagtggactacagttggttacaacagagcatctgctgtgtctaggtcaattaatgcatcacaagctggagatattattctttatgagatgcaaactggaggaaaggatggacagtactgcccagctgaatatgatcaggttatttgggatttgacaaaggctgcaaccgattctggaattattattattgctgcagctggaaatggtaaccaaaatcttgatgatccattctacgcaaactacttggctaggggaaattctggtgcaattattgttggagctggttctcctaacaccactcattcaaagctttctttctcaacctacggaaatagagttgatgtgcagggatggggttcttcagtgttggcagctggatatggttcttacgcaaagtacgataacgataataacaggacttataactacttctcaggtacttcttcagctacacctgttgtgtcttcagcagctatccttatccaatctttctacagacaaacaaccggacagtatttgaccccagcagctatgaagaatcttttgatctcaactggtattcctcaaggtggaaccgttactggacagaagattggtccacttcctaacgtgaagaatgcaattcttcagttggagtctaagtttgcaaccccagttaagactctttcagctttggaagtgaagatctatccaaacccttcttcatcttcaatcgctatccaatctaacgagaataagaagcttgatatcgaaattattaatttgcagggtagaacagttattaagtcttcagtgctttctcacgaaaagatcgatatctcacaattgcctgctggacagtacattattaacattaatgagggtcaaagaagggttgtggaaaagttgaccaagattcatcaccatcaccatcactgataagagctc

SEQ ID NO: 1132 - DNA, 1697 bp, Artificial sequence
  Optimized for Zea mays
actagtacaggacgacccaagcaagcaagcaagcagcgagtacatacatactaggcagccaggcagccatgcaggactcccagcataggatggcgaatgaccagaatagcgttatctacgtgtgcttcagcaaggggatcaacagcgagaaggcggcgttctccaggaacgccgacctcgagcgcttctccagggagaaccacatcagcttcaagtacgacctcgatttcaccgacaacaagctggacgagatggcgcgcaactccaaggccatcggcaactccacggagagcgtggagaagctcaagaggatctacaaggccgacctccccctgcagagcacggagacggccgagaagatcatccgcaccctggagaggttcccggagatcgagtatgtgtccgtgatgtcggcggagccggtggagccgcccctcgtgaacgccttcgtggctacccccgacctcgagtccctgcagacgtacctgaacgacaaccccggcatcaacgcgaagtacgcctggagcaggggcatcaccggccagaacatccgcgtgagggacgtcgagtacggcttctacaagacgcacgagatgctctccaaccagaacagcatccagctggagcccggctactccccaaactcgggcctggcgaacaacaactaccgcgaccacggcacggcggtggtgtccatcctgggcagcatcaaggacaacatcggcctgacgggcgcggcctactccacgagcgagatcaagggctacatggagtggaccaccgtggggtacaacagggcctcggccgtctcccgcagcatcaacgccagccaggcgggcgacatcatcctctacgagatgcagaccggcggcaaggacggccagtactgccccgccgagtacgaccaggtcatctgggacctgaccaaggcggccaccgactccggcatcatcatcatcgcggccgcgggcaacggcaaccagaacctcgacgacccgttctacgcgaactacctggccaggggcaactcgggcgcgatcatcgtgggcgcgggctcccccaacaccacccacagcaagctctccttcagcacctacggcaaccgcgtggacgtccagggctggggctccagcgtcctggccgctggctacggctcctacgcgaagtacgacaacgacaacaacaggacgtacaactacttcagcggcacctccagcgctaccccggtggtgtcctccgccgccatcctcatccagtccttctaccgccagacgaccggccagtacctgacccccgccgccatgaagaacctcctcatcagcaccggcatcccacagggcggcacggtgaccggccagaagatcggccccctcccaaacgtcaagaacgcgatcctccagctggagtccaagttcgccacgcccgtgaagaccctctcggctctggaggtcaagatctacccgaacccctccagctccagcatcgccatccagagcaacgagaacaagaagctcgacatcgagatcatcaacctgcagggccgcaccgtgatcaagtccagcgtcctctcccacgagaagatcgacatcagccagctgcccgccggccagtacatcatcaacatcaacgaggggcagaggagggtcgttgagaagctgacaaagattcaccaccaccaccaccactagtaggagctc

SEQ ID NO: 1133 - DNA, 1835 bp, Artificial sequence
  Optimized for Zea mays
actagtacaggacgacccaagcaagcaagcaagcagcgagtacatacatactaggcagccaggcagccatggctccgacagtgatgatggcgtcttcggctacggcggtggctcctttccaggggctcaagtctacagcgtctctcccagtggcgaggaggtccagccgctccctcggcaacgtgagcaacggcggcaggatcaggtgccaggactcccagcacaggatggcgaacgaccagaacagcgtgatctacgtctgcttctccaagggcatcaacagcgagaaggccgcgttctccaggaacgccgacctggagcgcttctccagggagaaccacatcagcttcaagtacgacctcgatttcaccgacaacaagctggacgagatggcgcgcaactccaaggccatcggcaactccacggagagcgtggagaagctcaagaggatctacaaggccgacctccccctgcagagcacggagacggccgagaagatcatccgcaccctggagaggttcccggagatcgagtatgtgtccgtgatgtcggcggagccggtggagccgcccctcgtgaacgccttcgtggctacccccgacctcgagtccctgcagacgtacctgaacgacaaccccggcatcaacgcgaagtacgcctggagcaggggcatcaccggccagaacatccgcgtgagggacgtcgagtacggcttctacaagacgcacgagatgctctccaaccagaacagcatccagctggagcccggctactccccaaactcgggcctcgcgaacaacaactaccgcgaccacggcacggcggtggtgtccatcctgggcagcatcaaggacaacatcggcctgacgggcgcggcctactccacgagcgagatcaagggctacatggagtggaccaccgtggggtacaacagggcctcggccgtctcccgcagcatcaacgccagccaggcgggcgacatcatcctctacgagatgcagaccggcggcaaggacggccagtactgccccgccgagtacgaccaggtcatctgggacctgaccaaggcggccaccgactccggcatcatcatcatcgcggccgcgggcaacggcaaccagaacctcgacgacccgttctacgcgaactacctggccaggggcaactcgggcgcgatcatcgtgggcgcgggctcccccaacaccacccacagcaagctctccttcagcacctacggcaaccgcgtggacgtccagggctggggctccagcgtcctggccgctggctacggctcctacgcgaagtacgacaacgacaacaacaggacgtacaactacttcagcggcacctccagcgctaccccggtggtgtcctccgccgccatcctcatccagtccttctaccgccagacgaccggccagtacctgacccccgccgccatgaagaacctcctcatcagcaccggcatcccacagggcggcacggtgaccggccagaagatcggccccctgccaaacgtcaagaacgcgatcctccagctggagtccaagttcgccacgcccgtgaagaccctctcggctctggaggtcaagatctacccgaacccctccagctccagcatcgccatccagagcaacgagaacaagaagctcgacatcgagatcatcaacctgcagggccgcaccgtgatcaagtccagcgtcctctcccacgagaagatcgacatcagccagctgcccgccggccagtacatcatcaacatcaacgaggggcagaggcgggttgtggagaagctgaccaagattcaccaccaccaccaccactagtaggagctc

SEQ ID NO: 1134 - DNA, 1896 bp, Artificial sequence
  Optimized for Glycine max
ccatggtttaggtctctctatctacatataaatacacaaaaaattccattatcaatggcatcttcaatgctttcttcagctgcagttgtgacttctccagcacaggctacaatggttgctccttttaccggattgaagtcttcagctgcattcccagtgacaagaaagaccaacaaggatattacatctattgcttcaaacggaggaagggtttcttgtatgaaagtgtggccacctattggaaagaagaagtttgagaccctttcttatcaagattcacagcatagaatggcaaacgatcaaaattctgttatctatgtgtgcttctctaagggtattaactcagaaaaggctgcattttcaaggaatgctgatttggagagattctctagggaaaaccacatctcttttaagtacgatcttgatttcaccgataataagttggatgagatggcaagaaactctaaggctattggtaattctactgagtcagttgaaaagcttaagaggatctataaggcagatcttcctttgcaatcaactgagacagctgaaaagattattagaactttggagaggtttccagagattgaatacgtttctgtgatgtcagctgagcctgttgaaccacctcttgttaacgcattcgtggctaccccagatcttgaatctttgcaaacttatttgaacgataaccctggaattaacgcaaagtacgcttggtcaaggggaattactggtcagaatattagagttagggatgtggagtatggtttctacaagacacatgaaatgctttctaaccaaaactcaatccagttggaaccaggatattctcctaactcaggtcttgcaaacaataactacagagatcacggaacagctgttgtgtctatccttggttcaattaaggataacatcggattgactggtgctgcatactctacatcagagattaagggatatatggagtggactacagttggttacaacagagcatctgctgtgtctaggtcaattaatgcatcacaagctggagatattattctttatgagatgcaaactggaggaaaggatggacagtactgtccagctgaatatgatcaggttatttgggatttgactaaggctgcaacagattctggaattattattattgctgcagctggaaatggtaaccaaaatcttgatgatccattctacgcaaactacttggctaggggaaattctggtgcaattattgttggagctggttctcctaacaccactcattcaaagctttctttctcaacttacggaaatagagttgatgtgcagggatggggttcttcagttttggcagctggatatggttcttacgcaaagtacgataacgataataacaggacatataactacttttcaggtacctcttcagctactcctgttgtgtcttcagcagctatccttatccaatctttctacagacaaacaaccggacagtatttgacaccagcagctatgaagaatcttttgatttcaaccggtattcctcaaggtggaaccgttactggacagaagattggtccacttcctaacgtgaagaatgcaattcttcagttggagtctaagttcgcaacaccagttaagaccctttcagctttggaagtgaagatctatccaaacccttcttcatcttcaatcgctatccaatctaacgagaataagaagcttgatatcgaaattattaatttgcagggtagaaccgttattaagtcttcagtgctttctcacgagaagattgatatttcacaattgcctgctggacagtacattattaacattaatgagggtcaaagaagggttgtggagaagttgactaagattcatcaccatcaccatcactgataagagctc

SEQ ID NO: 1135 - DNA, 1346 bp, Artificial sequence
  Optimized for Zea mays
ggatccacaggacgacccaagcaagcaagcaagcagcgagtacatacatactaggcagccaggcagccatgaacaacatcaccgagtacaacgacacggccaacttcgtgccgtacaacgtctacgccacctccgcgttcgagttcgactgggactccagcgccatcctcaagcaggcggtgctgaagggcatcagcttcatcccctacgtcggcgactacctgtccagcatcatcggcttcttctggaaggaccaggagcgcgacatctggcaggagatcctcggcagggtgcagcagctgatcgaggagaacgtcctcaaggccatcaagggcatcctcctgggcgacatcgccgagctgaagggcaagatcgcctcggtggtggcggccctccaggaccaccccggcacccccgaggcgaagtccctgttcatgtccgtgagcgtccacctcgacagcgtgcagcgcaagttcaccacgttcgaccacaagacgaactaccacatcctgccgatgtactccgccaccgcgctcatgcagatcatgtactggacgatgggcatcgagcgcaaggacgacatcggcctgaacagcaacgaggtcggccagctccagaggaacatcaacctcctggtgacccacgtcgaggactacgtccagggcatctacgacacggagctggagatccagtacaacgactccgcccccaacaccgtggcgaacaacgtgatgtatgtgcacggctactgcagggtccacggcctcgagtacaccgagatcatccagtccatccagaacaacggcagcaacacgaagggcctctactccaagatcctgtcctacagcaccttcttcggctggcccacctcccaggctcgcatcctcgccctgaaggacgaggtgaacatgccggagcccttcaagcccaagctcatcaacggccgcatcaaccaggtgaagagcgtcaagggctacatcaggcggatcggcggcgccctcagggtcggcggcctggagatcaccttcgagaacggctccaagtacagccagggcaccgtgacgggcgagttctccagcatcgacctgaacggctccgtcatcgagaccatggagacctggggcagcggcgctatcgacgaggcgaagttcaccctctcggacggccgcaccttcacggtgggccagcgctacagcacgaactacaggaagttcgcgctggagggccactacatctccggcatcttcatcgcctcggacaggtcggagctggccggccaggctgccaacatctgcgtcagctaccaccagaagcagcaccaccaccaccaccactgatgagagctc

SEQ ID NO: 1136 - DNA, 506 bp, Artificial sequence
  Optimized for Zea mays
ggatccacaggacgacccaagcaagcaagcaagcagcgagtacatacatactaggcagccaggcagccatgagcaaggtcaccatcacgatcgactccaacagcaacgaggtggacgtcaagaacagcaccgaggccgacaccgagtccctggccctgacggcggcccaggtgcgcaccagggtgcccaccgaggtggctccaaactccagcacggaggtgctctacaggagcaccccgatcatcccggagtcccgcaggaacgtcatgatcaccaacgacggcgcggccaacgtgatcaccgcccagtactactggtcccacagcttcaccagccagtggttcctgtacacgtccatcgacgtgaacgtcggcgactccaagctcctggtctccccgagcaactccctctactacagcaaggtggtcctgatcaacaacacctccaggaaggcctacgtgacggcggaggagaagcaccaccaccaccaccactgatgagagctc

SEQ ID NO: 1137 - DNA, 2403 bp, Artificial sequence
  Optimized for Solanum lycopersicum
atggcatcatcagagaaagagattattaacgatcaggaggctaacttcaaaggattgcttggatactacttcaacgataaggaacttaaagaaacagctttgatttcaaattctgagtcaggagatcttttcgttgataacgatcaaattgatgatatgttgcctgatgaacttaagcaatttcaatcagctatgtggagaggttttattaaagttgaaaagtctggagagtacactttttctacatcagataacgatcatactatgttgtggattgatgatcatcaagttattgatcattcttcagctacacaaaagattgaattggagaagggaaaactttataagattaaaattacttaccaaccagaatcttcatctgctaatgagtttggtttgcaacttaattggattacacctcaaggaaaagaagagattattccagaaggtaatcttttgcttcctgatattaagaaccaaccagaaaatgagtcttcaagaaagaaaagatctatttcagcttctgatgatggagttgaagattcagatggagatggtattcctgattctttggaaattgagggttacactcttgatgttaaaaataagaagttgattcttatgccttggattgaaaaggttcatggaaaaaagagaacaaagtcaggtgctcctttgactaagtacacatcatctcctatgaaatggtctactgcttcagatccttattcagattttgctaaggtttctggtatgattgataagaaggttaaagttaagcatcctttgattgctgcttatccaaatcttcaagttcacatggataagtttattatttctaaaaatagaaatgagactcttgaaaatggtggaaacacttcatcttcaatttcaggatctacttcaacatctaatactcattcaacagaggcttctgttggtgctgaggttcatgcttcattgtttaatttcggaggttcagtttctacaaacttctcagattctaattcacaaactgttacaattgatagatcttcatctgaatctcttggaagaaattggtctaaatcattgggacttaatgctggagaggctgcttacttcaacgctaacattagatatgttaataacggaactgctcctatctatgaagctgctccaactacatcattggttcttggaaaaaatgatactattgctacaattaaagctaaggagaatcatttggctaatgttgttcttcctgatagattttatccagataaagatcaagctgctatttcattgcaaacaaaggatgatttcggttcatctcctattactattaataaggatcaattgactattcttgaacaaacacaacaaatgagattggagactgatcaagtttctggatatgttggtgttattgatccaaagacaaaacttattgttgttgataaggataagcaatggtcacatattattcctcaaattgaagagactacagctagattgattcttaagacaccagataactctgaattggagagaagagttgctgctgttgatcctgatgattatactgaacaaacaaagccagatgttactcttggagaagctcttcaacttgcttttggatttgaggataagcagggtaaattgtcatacaataacacatctattgatgatttcagacttgttttcgatgaagagactgctgaaaacattgagaagcaacttgaagatatggagacaaagaacatctataacgttcaattgcatgctaggatgaatattcttatttctcctaaaaaggatgaaccaggagttcatgaaggtttgtcatcttgggaaattgatggagaggataactactataagtacgatgttcttcaaactggatggcaaactattaacggaaagaaatactacttcaatgagaatggtactcttgttcctaataaggttattgaggatggtacttatcaaattaatacagctttgaagaatacttcacttgttgattggaacagatctgataataacattactgtttgggaaacaaatgatggttcaaaccaaaagtggaaacttaagtacgatgattcacaacaggcttatgttattagatctgttgagaataacgataaaattatggcttggaacgcttaccaaaattctacaaacgttttcgctactgcttttgaaggaaagcctgagcatttttggattccagaattgcttggtaacgatttgtacattcttaagaataagaaagatcctacaaaggttcttgatgttgatggatctggtacttcaaatggttctaatattcaagtttcagattacaagggaacagataaccagaagtggaagttggagcagttggaagcaaatcaccaccaccaccaccactaataa

SEQ ID NO: 1138 - DNA, 2403 bp, Artificial sequence; identical to SEQ ID NO: 1137
  Optimized for Solanum lycopersicum

SEQ ID NO: 1139 - DNA, 2463 bp, Artificial sequence
  Optimized for Glycine max
ccatggtttaggtctctctatctacatataaatacacaaaaaattccattatcaatggcatcttcagagaaggaaattattaacgatcaggaggctaacttcaagggacttttgggttactacttcaatgataaggagttgaaggaaactgcacttatttcaaactctgagtcaggagatttgttcgttgataacgatcaaatcgatgatatgttgccagatgaacttaagcaatttcagtcagctatgtggagaggattcattaaggttgagaagtctggtgaatataccttctctacttcagataacgatcatacaatgctttggattgatgatcatcaagtgattgatcactcttcagcaacccagaagattgagttggaaaagggaaagctttataagattaagatcacttaccagcctgagtcttcatctgctaacgaatttggtttgcaacttaattggattacaccacagggaaaggaggaaattattcctgagggtaatcttttgcttccagatattaagaaccaacctgagaacgagtcttctagaaagaagaggtctatttcagcatctgatgatggagtggaagattcagatggagatggtattccagattctttggagattgaaggttatacccttgatgttaagaacaagaagttgatccttatgccttggattgaaaaggtgcacggaaagaagagaacaaagtcaggtgctccattgacaaagtatacctcatctcctatgaagtggtctaccgcatcagatccatactcagattttgctaaggtttctggtatgattgataagaaggttaaggtgaagcatccattgattgctgcataccctaatcttcaagtgcacatggataagttcattatctctaagaacaggaatgagacccttgaaaacggaggtaatacttcatcttcaatttcaggatctacatcaacctctaatactcattcaacagaggcttctgttggtgcagaagtgcacgcttcattgtttaacttcggaggttcagtttctaccaacttttcagattctaactcacaaactgtgacaatcgatagatcttcatctgagtctcttggaaggaactggtctaagtcattgggacttaatgcaggtgaagctgcatacttcaacgctaacatcagatacgttaacaacggaactgcaccaatctatgaggctgcacctactacatctttggtgcttggaaagaacgataccattgcaactattaaggctaaggaaaaccatttggctaatgttgtgcttccagatagattttaccctgataaggatcaagctgcaatttcattgcagacaaaggatgatttcggttcatctccaatcaccattaacaaggatcaattgacaattcttgagcagacccaacagatgaggttggaaaccgatcaggtttctggatatgttggtgtgattgatcctaagactaagcttattgttgtggataaggataagcaatggtcacacattattccacagattgaggaaaccactgctaggttgattcttaagactcctgataactctgagttggaaagaagggttgctgcagtggatccagatgattatacagagcaaaccaagcctgatgttacacttggagaggcattgcaacttgcttttggattcgaagataagcagggaaagctttcatacaacaatacctctatcgatgatttcagacttgtgttcgatgaggaaactgcagagaatattgaaaagcaacttgaggatatggaaacaaagaacatctataacgttcagttgcatgctaggatgaacattcttatttctccaaagaaggatgagcctggagtgcacgaaggtttgtcatcttgggagatcgatggagaagataactactacaagtacgatgttcttcaaactggatggcagactattaacggaaagaagtactacttcaacgagaacggaactcttgttccaaacaaggttattgaagatggtacttaccaaattaacacagcattgaagaatacctcacttgttgattggaacagatctgataacaatatcaccgtgtgggagactaacgatggttcaaatcagaagtggaagcttaagtatgatgattcacaacaggcttacgttattaggtctgtggaaaacaatgataagattatggcttggaacgcataccaaaactctactaacgttttcgctacagcattcgagggaaagccagaacatttctggattcctgaattgcttggtaacgatttgtacatccttaagaataagaaggatcctactaaggttttggatgtggatggatctggtacatcaaacggatctaatattcaagtgtctgattacaagggtactgataaccaaaagtggaagttggagcagcttgaagctaatcatcaccatcaccatcactgataagagctc

SEQ ID NO: 1140 - DNA, 1100 bp, Artificial sequence
  Optimized for Zea mays
actagtacaggacgacccaagcaagcaagcaagcagcgagtacatacatactaggcagccaggcagccatggcccccacggtcatgatggcctccagcgctacggccgtggctcccttccagggcctcaagagcacggccagcctgccggtggctaggaggtccagcaggtccctgggcaacgtgagcaacggcggcaggatccggtgcgcggccggcgtcaccaacacggctgcgaccgacgccggcatcgtggactggtccaccccgatcgaccacgcgatggacatctacggccagcacgcgggcaagccgggcacgtacggtggcagcggcctcctgggcggcttcaccgacgtcaagtaccgggagttctccgtggaggcggacggcagcccaatcctctccaacagcaagacggtgttcgtcggctccagcaccctcgtcaacgactccgacatggagcagaccctgtccacggacagcttcacccagcagttcacgaacagcgtgacctccagcaccacgaccggcttcaagttcggcgagaagatctccagcaagttcgagatcccgctggtcgccgaagtgggcgcggaggtctccacggagttcgacttcagcgacacctccagcaacacgaagacggagacccacacctacaccgcccagccacagaacatcaaggtgccgccccactccagcgtggaggtcatcgtgaagctcgacacggtcaaggcctccggcaacgtgaagctcctgtccaagatgagcggccagaagaccggctccatcatctactacaacccgagcgtccagtacttctacaacctgagcttccacgacatcgtggacgaggcgtccaagtacgagaagctcagcaacgtctacgccaacccggacgagaccatcacgctggtgggcgccggcaactacgaggctgagtacggcacccagttcatggtccaggtcatgaagccgaagcccctcaacgagaacggccgcgtcaagagggacctgcacgaggaggactacgcgtacgaggtgaccccggtggtcaacaaggccgagcaccaccaccaccaccactgatgagagctc

SEQ ID NO: 1141 - DNA, 962 bp, Artificial sequence
  Optimized for Zea mays
actagtacaggacgacccaagcaagcaagcaagcagcgagtacatacatactaggcagccaggcagccatggcggccggcgtcaccaacacggcggccaccgacgcgggcatcgtggactggtccaccccgatcgaccacgccatggacatctacggccagcacgccggcaagccgggcacgtacggtggcagcggcctcctgggcggcttcaccgacgtcaagtacagggagttctccgtggaggccgacggcagccccatcctctccaacagcaagacggtgttcgtcggctccagcaccctcgtcaacgactccgacatggagcagaccctgtccacggacagcttcacccagcagttcacgaacagcgtgacctccagcaccacgaccggcttcaagttcggcgagaagatctccagcaagttcgagatcccgctggtcgcggaagtgggcgccgaggtctccacggagttcgacttcagcgacacctccagcaacacgaagacggagacccacacctacaccgctcagccacagaacatcaaggtgccgccccactccagcgtggaggtcatcgtgaagctcgacacggtcaaggcgtccggcaacgtgaagctcctgtccaagatgagcggccagaagaccggctccatcatctactacaacccgagcgtccagtacttctacaacctgagcttccacgacatcgtggacgaggcctccaagtacgagaagctcagcaacgtctacgcgaacccggacgagaccatcacgctggtgggcgcgggcaactacgaggccgagtacggcacccagttcatggtccaggtcatgaagccgaagcccctcaacgagaacggccgcgtcaagagggacctgcacgaggaggactacgcctacgaggtgacccccgtggtcaacaaggcggagcaccaccaccaccaccactgatgagagctc

SEQ ID NO: 1142 - DNA, 2676 bp, Artificial sequence
  Optimized for Glycine max
ccatggtttaggtctctctatctacatataaatacacaaaaaattccattatcaatggcatcttcaatgttgtcttcagctgcagttgtgacatctccagctcaagctactatggttgctccttttactggacttaagtcttcagctgcattcccagtgaccagaaagactaacaaggatattacctctattgcttcaaacggaggaagggtttcatgtatgaaagtgtggccacctattggaaagaagaagtttgagactttgtcttacgcatcttcagagaaggaaattattaacgatcaggaagctaacttcaagggacttttgggttactacttcaatgataaggagttgaaggaaactgcacttatttcaaactctgagtcaggagatcttttcgttgataacgatcaaatcgatgatatgttgccagatgaacttaagcaatttcagtcagctatgtggagaggattcattaaggttgagaagtctggtgaatacacattctctacctcagataacgatcatactatgttgtggattgatgatcatcaagtgattgatcactcttcagcaacacagaagattgagttggaaaagggaaagctttataagattaagatcacctaccagcctgagtcttcatctgctaacgaattcggtttgcaacttaattggattaccccacagggaaaggaggaaattattcctgagggtaatcttttgcttccagatattaagaaccaacctgagaacgagtcttctagaaagaagaggtctatttcagcatctgatgatggagttgaagattcagatggagatggtattccagattctttggagattgaaggttacacacttgatgttaagaacaagaagttgatccttatgccttggattgagaaggtgcacggaaagaagagaactaagtcaggtgctccattgactaagtatacatcatctcctatgaagtggtctacagcatcagatccttactcagattttgctaaggtttctggtatgattgataagaaggttaaggtgaagcatccattgattgctgcataccctaatcttcaggtgcacatggataagttcattatctctaagaacaggaatgagacacttgaaaacggaggtaatacctcatcttcaatttcaggatctacatcaacctctaatacccattcaactgaggcttctgttggtgcagaagtgcacgcttcattgtttaacttcggaggttcagtttctactaacttctcagattctaactcacaaactgtgacaatcgatagatcttcatctgagtctcttggaaggaactggtctaagtcattgggacttaatgcaggtgaagctgcatacttcaacgctaacatcagatacgttaacaacggaacagcaccaatctatgaggctgcacctactacatctttggtgcttggaaagaacgatacaattgcaaccattaaggctaaggaaaaccatttggctaatgttgtgcttccagatagattttaccctgataaggatcaagctgcaatttcattgcagactaaggatgatttcggttcatctccaatcacaattaacaaggatcaattgactatccttgagcagacacaacagatgaggttggaaacagatcaggtttctggatatgttggtgtgattgatcctaagaccaagcttattgttgtggataaggataagcaatggtcacacattattccacagattgaggaaaccactgctaggttgattcttaagacacctgataactctgagttggaaagaagggttgctgcagtggatccagatgattatactgagcaaacaaagcctgatgttacccttggagaggcattgcaacttgcttttggattcgaagataagcagggaaagctttcatacaacaatacatctatcgatgattttagacttgtgttcgatgaggaaaccgcagagaatattgaaaagcaacttgaggatatggaaactaagaacatctataacgttcagttgcatgctaggatgaacattcttatttctccaaagaaggatgagcctggagtgcacgaaggtttgtcatcttgggagatcgatggagaagataactactacaagtacgatgttcttcaaaccggatggcagactattaacggaaagaagtactacttcaacgagaacggaactcttgttccaaacaaggttattgaagatggtacctaccaaattaacactgcattgaagaatacatcacttgttgattggaacagatctgataacaatatcacagtgtgggagaccaacgatggttcaaatcagaagtggaagcttaagtatgatgattcacaacaggcttacgttattaggtctgtggaaaacaatgataagattatggcttggaacgcatatcaaaactctaccaatgtttttgctactgcattcgagggaaagccagaacatttctggattcctgaattgcttggtaacgatttgtacatccttaagaataagaaggatcctaccaaggttcttgatgtggatggatctggtacttcaaacggatctaatattcaagtgtctgattataagggtactgataaccaaaagtggaagttggagcagcttgaagctaatcatcaccatcaccatcactgataagagctc

SEQ ID NO: 1143 - protein, 426 aa, Artificial sequence
  Optimized for Arabidopsis thaliana
MKLLELKSVYSEQEQERFYTRSISLGDWDYSAIIKSSVMFGLGQIPVVGKALSTIVGLFWPKNEKDVWQKSLDELREYIDNQILATIQGILNGELREIQKKMEYVARLLEESPGSPEACSEYKNLQFYLVGKDEKFRSFDELTNYKLMPMYASMILLQASYWKMGIDKKDQIGLSSIDLNSLKNHIDDLADSSRNYINRIYETELDRTYENSRPDEVANNMFAVRGYSLLHGVEAVEVVKNIRDLDFDKRFNINVISYSTAVGTITGGMIAQALTPDSEMAQPLCPEVFGQQANRIVQIIGYSGPRINSLFRIGGLEIIYENGDSSLLGERVGNRDVFDLNGSLIKTVEMRYQGLMDEVKFTLFDGRVMQVGQGESYSGYVKYEVEGHYISGVFLSRDRATYPGRTSTASVSFNMVPAISHHHHHH

SEQ ID NO: 1144 - protein, 426 aa, Artificial sequence; identical to SEQ ID NO: 1143
  Optimized for Arabidopsis thaliana

SEQ ID NO: 1145 - protein, 426 aa, Artificial sequence; identical to SEQ ID NO: 1143
  Optimized for Glycine max

SEQ ID NO: 1146 - protein, 426 aa, Artificial sequence; identical to SEQ ID NO: 1143
  Optimized for Glycine max

SEQ ID NO: 1147 - protein, 426 aa, Artificial sequence; identical to SEQ ID NO: 1143
  Optimized for Zea mays

SEQ ID NO: 1148 - protein, 138 aa, Artificial sequence
  Optimized for Arabidopsis thaliana
MKDQFSNNEIEKLSRGVGLETSPADESVQLLSGGTFTVPKHGSVQAAKYSTPVIPEIHKSYWIFNAGKANKIKAVFYWSHSFTSSWFEYSSVEVGIGEEKKLQAPSNSLYYSKVVLFNGTDQNATVSVTVAKHHHHHH

SEQ ID NO: 1149 - protein, 138 aa, Artificial sequence; identical to SEQ ID NO: 1148
  Optimized for Arabidopsis thaliana

SEQ ID NO: 1150 - protein, 138 aa, Artificial sequence; identical to SEQ ID NO: 1148
  Optimized for Glycine max

SEQ ID NO: 1151 - protein, 138 aa, Artificial sequence; identical to SEQ ID NO: 1148
  Optimized for Glycine max

SEQ ID NO: 1152 - protein, 138 aa, Artificial sequence; identical to SEQ ID NO: 1148
  Optimized for Zea mays

SEQ ID NO: 1153 - protein, 457 aa, Artificial sequence
  Optimized for Arabidopsis thaliana
MTTTIISTKKNGPGLRHGHVSTPESRAYFAWQEGRLNSGQLNQREAGKFFPATASGLTDSVAPTDSTNMLPPPDGKIASANQGDGEFLDEPGTHWKKHSVESAELLKVTWYYSAPHATRRWNYFITREGWNPNMPLSRAQFEDKPFYKVELEEQPFWSHAAALNPPNPTEHLVMLPQRSGYHVLLAVWEVANTGNAFYQVIDLDFIGDVSPTTPVAPGGLRASASTTSSITLKWNAAASAAEYRLYRNNTLIYSGDQLSFTDNGLPENTTYSYAVSSVNEAEVESAFSQPITASTSSDVNPDTPPTAPTHLHSMGITTNSVSLMWGASSSSVKLNGYLVYRDGNEIARVNVAQLSYTDTGLRPATAYRYFVVAEDIQGQLSGTSNVLSVSTDKDEDDSGGGTYPHWILGETYHAGDIVSHNGKNWVSYVTHVAHSPDWAPGLALSLWYELIHHHHHH

SEQ ID NO: 1154 - protein, 457 aa, Artificial sequence; identical to SEQ ID NO: 1153
  Optimized for Arabidopsis thaliana

SEQ ID NO: 1155 - protein, 457 aa, Artificial sequence; identical to SEQ ID NO: 1153
  Optimized for Glycine max

SEQ ID NO: 1156 - protein, 528 aa, Artificial sequence
  Optimized for Glycine max
MASSMLSSAAVVTSPAQATMVAPFTGLKSSAAFPVTRKTNKDITSIASNGGRVSCMKVWPPIGKKKFETLSYTTTIISTKKNGPGLRHGHVSTPESRAYFAWQEGRLNSGQLNQREAGKFFPATASGLTDSVAPTDSTNMLPPPDGKIASANQGDGEFLDEPGTHWKKHSVESAELLKVTWYYSAPHATRRWNYFITREGWNPNMPLSRAQFEDKPFYKVELEEQPFWSHAAALNPPNPTEHLVMLPQRSGYHVLLAVWEVANTGNAFYQVIDLDFIGDVSPTTPVAPGGLRASASTTSSITLKWNAAASAAEYRLYRNNTLIYSGDQLSFTDNGLPENTTYSYAVSSVNEAEVESAFSQPITASTSSDVNPDTPPTAPTHLHSMGITTNSVSLMWGASSSSVKLNGYLVYRDGNEIARVNVAQLSYTDTGLRPATAYRYFVVAEDIQGQLSGTSNVLSVSTDKDEDDSGGGTYPHWILGETYHAGDIVSHNGKNWVSYVTHVAHSPDWAPGLALSLWYELIHHHHHH

SEQ ID NO: 1157 - protein, 996 aa, Artificial sequence
  Optimized for Arabidopsis thaliana
MQNNDKIPQVVLPTPQAQLYEKYVNHPTVEYTGTPEITIPLYEITVKGLKIPISLSYHAGGIKYGQFDGDIGAGWTLSTGGYRVSRTVYGQPDEQYDMYDPNELEEMWNRPWTGDIRKKIERDTYFMGLERKLHQEAYVRTQDSQHDLFNYILPTTTGQYIISDKRNKTVVTDKQNGDKIILDEGGSLSLNSMKIIDTGGFTYLLGGQQTNPSALLVETTLIPGTSASFADKAGWPLRQIQSPYGGNIDFTYKLYELPSENRFGGSFTLTDASYFIASAATGPQYSTASGSVSLSNGRYKQYYIEKITTDKETIIFKRLGFSVPGVSPANTHALSEIEIRAKDNTLVKKIIFNHKKSPEGNTTIDGFWHMLLTSVSISNGTGEPQTYSFAYNEPTLSSPVYADQWGYYKNAYEGRPGGRIIWNKLFLHKEFADEVLMPWTNPNHSYEPTPLKYVWNGTYPGTASYNFVDRSNNSSAGLHFFSLSRITYPTKGSIEYAYQPNKYEAGGETISGSGQRVWKIISNTEDGKPSIVTEYTYGKNGDGLGSVSSSAYLSDRFFATTTILSEIISSDVTLVSSNKFSQVRTYSSSPYQADLLDLMTVVYPEVTTSQYDTSSRSYNGKIVSTYHIPFKIGCSSIGGTSIQLGNYPPPTKYWNDYYINIYNFGNQPYLKSRVTYNNSNLPLIRESFEYENLKSQIFKGIRAIQKQSCVDRPVFLYYELYESPYTYIDPMCIADRIETTLNFNRIKSKEVVSFEGSDSIKVTETYQYDALNRVTRSVTTNGIGSTRQIEYTYPSSGQLVTKNKIGEPVRTKTINNNIPTGIVEKTYPLNAINPSSLRSSTGNESTLRTDITYNQYDSKGNLLQYTRADGTIVSYLWSYNYQYPVAEIVNASYTTVTNNLSGVTAASLAGNANPDDTVLSAVKALRTLLTNAEVTVYKYRPLVGIIEHTDPQGISTWYDYDDLGRLRETCFKEFGIKRILESYDYNYRNQHHHHHH

SEQ ID NO: 1158 - protein, 996 aa, Artificial sequence; identical to SEQ ID NO: 1157
  Optimized for Arabidopsis thaliana

SEQ ID NO: 1159 - protein, 166 aa, Artificial sequence; identical to SEQ ID NO: 968
  Optimized for E. Coli

SEQ ID NO: 1160 - protein, 936 aa, Artificial sequence
  Optimized for Arabidopsis thaliana
MITPQISNIHAGTPTITAFDNRHFTVRTLQYYRQPNIQQDVQERLEFHYFNIYGFLQKNADARLSESGQDNFYYHADLMGFSLLNKGVDSGEIYQLNDIEQRLMVSIDANKTFKWCCYEANDSLGRLESVSEKIEGGNWRVSERFQYAGNSHTEQLANLAGQCISHFDTAGLLQTQEVSLQGEPTLLTRQFIQQVDNAEFNVDWQEDSDLTALSPEKFSHQTHFDAAGACLSIIDAKGHKQQREYDITGQLIRTTFTVKGQDTQPITQIIEYSAVGQKVREIYGNGAVTEYVYEAQTQRLILIQTYRPVNHSLGYKLFQSLHYDYDPVGNVIAIYNSAEKKVFWRNQKVEPKHRYQYDTLYQLVHATGREIAGISQQSHYLPHHSSIDNSVYTRYFRAYSYDKGGNLIQIHHRAPAMQQAYTIKMTTSSRSNHAVLADLAEFPHQVEPLFTPSGQQKQLLQGKNLTWTSRQELQSVNGAGGNEFYRYDGDSQRALKITQYNQKQSKVVYLPNLEIRQIEHNEKYHVICIGEDSEVQAQVLHWEIGLPDKMVNNTVRYSINGLTSNSGLELDMDGNLISQEEFYPFGGTAVWTVSSALEVNYKTRRYSGQERDITGLYYYGRRYYQPWVGRWLSADPAGTIDGLNLYRMVRNNPLTYQDEHGLAPRLFDTQDDMFADFQQTVSKLLNASSKIERIAKNPSLIRNRVISMAQLFYKDKTSKFTYAINLYEFLEMDSQSEEFKTWATNKLSYQNTSRQRQPGWETVNHAEQALIRTLTAHDSFNISNLIISQKAKLCSSCENAMYTFRQSMPKRRFTTMILRDGDLPLAAIQHGQSRTRYKNSSYSAGVAVGKTSFTLYDYKDIEFQVGMGNFWGGMDKTLYTMYANEFERVFGNLPIGKGVKKSFPPKPPKSSGGRGHQLDKNQPSTSRRHRHHHHHH

SEQ ID NO: 1161 - protein, 936 aa, Artificial sequence; identical to SEQ ID NO: 1160
  Optimized for Arabidopsis thaliana

SEQ ID NO: 1162 - protein, 525 aa, Artificial sequence
  Optimized for Arabidopsis thaliana
MNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCQFYFYDTGDLDLIVNHVQPGDIVSLDIQFSVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESAHHHHHH

SEQ ID NO: 1163 - protein, 525 aa, Artificial sequence; identical to SEQ ID NO: 1162
  Optimized for Arabidopsis thaliana

SEQ ID NO: 1164 - protein, 525 aa, Artificial sequence; identical to SEQ ID NO: 1162
  Optimized for Glycine max

SEQ ID NO: 1165 - protein, 596 aa, Artificial sequence
  Optimized for Glycine max
MASSMLSSAAVVTSPAQATMVAPFTGLKSSAAFPVTRKTNKDITSIASNGGRVSCMKVWPPIGKKKFETLSYNIKIFKFIDIYTNGIFVEFNNKENKLLSINLLLNDEIIEKTETTGESHLFSIDKSGHYRVEISLEAENTANIQSKEIYFHISEGERKNKIKTTTKEKTINQKIAGISNYYLDIKAKKKNYDKIKQDLTFYSKLPTLELKRSLIYDTLNEYDYFTFHGDGKFEILVELAEQIESLDYVEYCSVTPDTTGYLAPELPVNPEQLDDIKSESDDFITPDFTPRQTYLDAPKGMNIRDAWAKNINGSSAVVRHLDFGVYRNHEDLIDSNIVVVNSRPESEDCNHGTASTGCIVATLNKFGVTGIAHHCQFYFYDTGDLDLIVNHVQPGDIVSLDIQFSVGGKLLPATAIRSWWERMKIIVDKGATVILAAGNGGLDLSEPGVMQDFGDSGSILVGACNHQNGTRAYFSNYNPEVAFVNSWGDWSVTTTGYGSLQKLPGNNRNYSNNYSGTSSATPLCSGALALIQDYAKKQGAILSPWQMRTVIAASNYTEGVSHGIGCRPNVDYLFGIVDSIIRKSDLPESAHHHHHH

SEQ ID NO: 1166 - protein, 692 aa, Artificial sequence
  Optimized for Arabidopsis thaliana
MQITYLDDLPTLGSNAFQFEGTQSGDSTERFLAEYGQNAANFVSEEKKQKKLADMAQDYARHKAANIATDEITQWLSKAGNTRLNINLNEKLSIKTSQLDWLVPWYDQHDFLLFSQHSIHRTDGRLQSNNGIGLRHFHQNSMVGINAFFDHDLSHYHSRLGLGLEYAQDYARVSTNSYLGLSTWRSASELAYNYYVRPANGWDIQLEGWLPAYSNLGANLKLEQYYGDDVALFGTNERQKNPMAATVGVNWSPFPLLALNVEHRIGNNGANETGAKIAFNWLLGRSLEQHLDTSVIEANRHIPNNRYDFVNRNNNIVLEYQKKTLISLSLPKVIQGVTGEERSIIRNLTTKYPIEKIVVDAPELIAAGGRLHLNGIDSSVKLPSYKITNNALKNQQLNLYRLTVTVYDTKGNVSPQVETLIEVTGTGALTITHENTKKRNNGIADGKDANTFAIVIKDPLGHPVPNAKVNFVLPANLRSIDQKNTGYYSLLNHFMWKAKAKKAVSEQKYNIIANDKGEASIQFTTFISGSYVVKANTEYGPEINEMYHFKPDISQSFISSIDIIRNNVAADGISKNKIKLRIINNSRQSIAGALVHFEASNGIISPANLTDEYGNTELEISSLVEGSIDIIATLNGDSRTIQVNFLKYAPTSYIQPSTESLFKPSINEQNRHTSLSLLRELFQKIGHHHHHH

SEQ ID NO: 1167 - protein, 692 aa, Artificial sequence; identical to SEQ ID NO: 1166
  Optimized for Arabidopsis thaliana

SEQ ID NO: 1168 - protein, 721 aa, Artificial sequence; identical to SEQ ID NO: 978
  Optimized for Arabidopsis thaliana

SEQ ID NO: 1169 - protein, 721 aa, Artificial sequence; identical to SEQ ID NO: 978
  Optimized for Arabidopsis thaliana

SEQ ID NO: 1170 - protein, 987 aa, Artificial sequence
  Optimized for Arabidopsis thaliana
MIEHPFSLLRNLARTGNDTHEHGDETLSFINAMEKLNIHSVFDIVRRSKSAFVHELSRISDAGAALAYENARCYATQIVRLYRNQLLSSGRTQQLTQRTGVRSLVDIGPGFPNLFKENWDLFCKVGAIEAKDSPVAYLTSLYRFALEQLEGSVAEPSRIKLDERRPDLKDLLIDHQSTFTPVPTLHIVNQVLSKAINAYVGTVPEDKGKTIYQLVAEKQHPFQFPYNFHFQQISLGLDGKKPTLGELSYRVSLEVPTTSRYGSDYGKVQHSSAIAQVLMSGAGPEQQAIVLEPALSSQANADTSADLTRQFFKTKYNVDYVDDASNPLNNLNAFLEKTGLDSDGVEALLAIGNHTAYASPNILSAGHTTDEDSPREASLTAIKARFGAGYVNGPTTQPAMALNKDAYGIKRLVNTSVDRFDRLQRMIRLQRWTGIPFTALDTLVMAVVRSEGAVNPQMVLTVNTLRALGTYRYLNKRYGLAPDEFAAFVHQMPGEANDGRLPMFDRVFNNPALFDTPLVLDGSTLYLDQHSSQHVKARAQLSRALHLSSTHEGLRQLAIDVRELIGNAPTDFRLNLSMISSLYRQARIASMFGLTTAECRALIDLLGSLSFRKKVVSGQLDDTEPDVLDILMQLDWAVTWLEASDRDVTTLRRQAGWDMTETIVTQELTVQLEQLTNDARLAVLKGDQLASLDLPSKDDQNNTLNWWAILYYHLIDGFGLVTTQPLDEEPAVSIRRTLHERLSSIAIAEPLASEVEARLATFVLNGYRNQHRLVEELLLTLTGLPPDRCEPVIRWAGSDVSKFLAALLWDNGVIETLSMLIRYSEVSQQLGLSARALRTFLINPRWLYAGSEGQFYLSPNSLYLLDRYSNWRDNCGYPEEALLEYFKQANDPQRDATQCAARLASLTGWTSSEVLAANALLTGSDRIASSMHEVDWLSRMHSASDVTGLSARQLLSATDLTATSTASHWKSVGEAVIAANRHHHHHH

SEQ ID NO: 1171 - protein, 987 aa, Artificial sequence; identical to SEQ ID NO: 1170
  Optimized for Arabidopsis thaliana

SEQ ID NO: 1172 - protein, 932 aa, Artificial sequence; identical to SEQ ID NO: 986
  Optimized for Arabidopsis thaliana

SEQ ID NO: 1173 - protein, 932 aa, Artificial sequence; identical to SEQ ID NO: 986
  Optimized for Arabidopsis thaliana

SEQ ID NO: 1174 - protein, 425 aa, Artificial sequence
  Optimized for Arabidopsis thaliana
MQTENVLDIRTIVANEYAVKTSALEWDVTDIVKNAIIGGISFIPSVGPAISFLVGLFWPQSKENIWEGIVKQIERMIEESALKTIKGILAGDIAYIQERMATVADLLEKHPGSAEARNAFNNLAENIDGYHKKFNNFSDDVNYQILPMFSTTVMMQITYWVAGLERKEEIGLSDIDIEKVRGLVKKTVEQANSYINNIYDRELNDALNNSTADTVVNNVMSVHGHCRLHGIEYISIWDRLSETESVNNRIYVDVLSYSTFFDRQTAKARIQALTPEKDMTPPLKPALNGGKRRKINSLMGHIVRIGGAPRVGGLTVVFDDGSRHQLGTISGETASISLDSSRITSLEVWGNGAVDKAVFTLSDGRSLSFGEPGTSRYRKFYVGESHYISGIYLSSDYSPLVGQAANIAVSYQLINDDEKHHHHHH

SEQ ID NO: 1175 - protein, 425 aa, Artificial sequence; identical to SEQ ID NO: 1174
  Optimized for Glycine max

SEQ ID NO: 1176 - protein, 425 aa, Artificial sequence; identical to SEQ ID NO: 1174
  Optimized for Glycine max

SEQ ID NO: 1177 - protein, 425 aa, Artificial sequence; identical to SEQ ID NO: 1174
  Optimized for Zea mays

SEQ ID NO: 1178 - protein, 425 aa, Artificial sequence; identical to SEQ ID NO: 1174
  Optimized for Zea mays

SEQ ID NO: 1179 - protein, 139 aa, Artificial sequence
  Optimized for Arabidopsis thaliana
MSRITIFIDSDEQKSEVYSNSTVPVRKELNTVFPLSELTISPGSSVEVFRIDTPIIPESRRSLRVVNTGLASHVTAKFYWSHSFTSEWFESGSIDVGLGEDKVLNVPNNSFYYSKFVIYNNSDKVAYITANLVHHHHHH

SEQ ID NO: 1180 - protein, 139 aa, Artificial sequence; identical to SEQ ID NO: 1179
  Optimized for Glycine max

SEQ ID NO: 1181 - protein, 139 aa, Artificial sequence; identical to SEQ ID NO: 1179
  Optimized for Glycine max

SEQ ID NO: 1182 - protein, 139 aa, Artificial sequence; identical to SEQ ID NO: 1179
  Optimized for Zea mays

SEQ ID NO: 1183 - protein, 139 aa, Artificial sequence; identical to SEQ ID NO: 1179
  Optimized for Zea mays

SEQ ID NO: 1184 - protein, 460 aa, Artificial sequence
  Optimized for Arabidopsis thaliana
MQQPKVWSEYGIEGCIYYEDKYGYLSLKTDGNPSEHNWYFPSDGTSNNRWDFIQWRAGIFTDPKQWGDSGAKGDIYYSKEYLSFFILQKNGNPSEHNWYFPSDGTSNNRWDFIQWRAGIFTDPKQWGDSGAKGDIYYSKEYLSFFILQKNGNPSEHNWYFPTDGNDNAQWIVKGNIKKQEWIKYINDERPINQISLPGTHDSATYTIGSAAIVSSYAKTQDDSIFEQLESGIRFIDARCRHISDVFAMHNGNIYLNINFGTILNDCYRFLEQHPDEFILMSVKKEHTEENNTRSFDKTFEIKYYDSSRWFVEDRIPKLKEVRGKIVLLRRFSGGSLGVNAASWPDNQTFNTENKIHVQDEYNQHNEAKKWHAIKNAWDFGVDNSKKGWLVLNFTSIAADTFTSIRSYALDKNPEMAKYISGTKANGGVVISDFPKIGKIAENVIITNFGEVEKFHHHHHH

SEQ ID NO: 1185 - protein, 460 aa, Artificial sequence; identical to SEQ ID NO: 1184
  Optimized for Arabidopsis thaliana

SEQ ID NO: 1186 - protein, 978 aa, Artificial sequence
  Optimized for Arabidopsis thaliana
MIENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPENHHHHHH

SEQ ID NO: 1187 - protein, 978 aa, Artificial sequence; identical to SEQ ID NO: 1186
  Optimized for Arabidopsis thaliana

SEQ ID NO: 1188 - protein, 190 aa, Artificial sequence; identical to SEQ ID NO: 1000
  Optimized for Arabidopsis thaliana

SEQ ID NO: 1189 - protein, 190 aa, Artificial sequence; identical to SEQ ID NO: 1000
  Optimized for Arabidopsis thaliana

SEQ ID NO: 1190 - protein, 494 aa, Artificial sequence
  Optimized for Arabidopsis thaliana
MMSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGKHHHHHH

SEQ ID NO: 1191 - protein, 494 aa, Artificial sequence; identical to SEQ ID NO: 1190
  Optimized for Arabidopsis thaliana

SEQ ID NO: 1192 - protein, 494 aa, Artificial sequence; identical to SEQ ID NO: 1190
  Optimized for Zea mays

SEQ ID NO: 1193 - protein, 540 aa, Artificial sequence
  Optimized for Zea mays
MAPTVMMASSATAVAPFQGLKSTASLPVARRSSRSLGNVSNGGRIRCMSTDQQSALQGQPLNGASEPIISAQFKYEIDYNNAARVVITTGLDQIPMVGFVLGALVEIFWPSSQQDVWSEIEAKVEQLVDAKISELVYQQVQESLAGLHNNLNEYLWAVKNTKDPNYITQKFNIAHGHFIQELPHFQSKGYELLLLPLFAQFANLHLSLLRDGVIYGASWGWGEDVQRHLREQIVETIQQYVQYTDTTYTEGLQNTQSKAPSNSHYTEPFNTVNQYIREMTLTVLDFKTMWPYYDPTQYPNPVKIYLDREIYSDAVGTADNSGPITLPSPPTKAITKIEVWAWDRIDGCQVTYEQGGGPNGVTQTPRMGDQGGGSSSPPHGGVFDLVTRGPVVGVKTLSGSILNAWWFTFDDGSTSNQLGGNYPGGSDHSFSYPDEILSSIKIMGVSNYYKSADCAVFGFKFKQEQSLPEPALLRTMYVASPAKISPEELARCVGAEDIDKTGKLIQEWSDFYHWDTIRQSHWDRIQTVVDSQGKHHHHHH

SEQ ID NO: 1194 - protein, 101 aa, Artificial sequence
  Optimized for Arabidopsis thaliana
MRYDDYHEAWEMNPRKLSTEEIENPGKVIEDFFRVSHLPGMRSSLWELMKTMVTGTFSNLKSRERARLIYFYEQVEKLIEAAHVLHEKNKGLSPSHHHHHH

SEQ ID NO: 1195 - protein, 101 aa, Artificial sequence; identical to SEQ ID NO: 1194
  Optimized for Arabidopsis thaliana

SEQ ID NO: 1196 - protein, 520 aa, Artificial sequence
  Optimized for Arabidopsis thaliana
MNIKTFKFIDKYSNGIVVNFDNRNKKTVTISLFLDNENIKTISTNNDHYLFKVDKSGNYHVTISFIDSNKNIHHLIDSPASYYFAQQKTKQNIKKESKSKTINHKIDGINKYFLEIKSEIKSSHLIMDILPNELMNSKLILIKSNIESSVKQYEYLNLYGEDNFDRLLELSQKIEQLDYVSYCCICPDTTGYLPPKLPLNSQVLEEDTSSNEITPNFTYLQKYLDAPMGMNVRNAWEKNIDGSQAVVRHLDFGVYKNHEDLKNSNLIVVNSRPETQDCNHGTASTGCIIATKNAFGVTGIAHNCQFYFYDTDDLDQLTNDAQPGDIVSLDIQFSFGEKLLPATAVRNWWERIKIMVDKGATVILAAGNGGLDLSEPGVMTDFGDNGSMLVGACNNQTGSRAYFSNYNQKSSLINSWGDWSVTTTGYGSLQKYPGNERNYTKDYSGTSSATPLCAGALALLQGYAKQHQIILSAWGMRELIKKSTYTEGVNDGIGYRPNVNDLLKEIDKLAQITEHHHHHH

SEQ ID NO: 1197 - protein, 520 aa, Artificial sequence; identical to SEQ ID NO: 1196
  Optimized for Arabidopsis thaliana

SEQ ID NO: 1198 - protein, 539 aa, Artificial sequence
  Optimized for Arabidopsis thaliana
MQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKIHHHHHH

SEQ ID NO: 1199 - protein, 539 aa, Artificial sequence; identical to SEQ ID NO: 1198
  Optimized for Arabidopsis thaliana

SEQ ID NO: 1200 - protein, 539 aa, Artificial sequence; identical to SEQ ID NO: 1198
  Optimized for Glycine max

SEQ ID NO: 1201 - protein, 539 aa, Artificial sequence; identical to SEQ ID NO: 1198
  Optimized for Zea mays

SEQ ID NO: 1202 - protein, 585 aa, Artificial sequence
  Optimized for Zea mays
MAPTVMMASSATAVAPFQGLKSTASLPVARRSSRSLGNVSNGGRIRCQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKIHHHHHH

SEQ ID NO: 1203 - protein, 610 aa, Artificial sequence
  Optimized for Glycine max
MASSMLSSAAVVTSPAQATMVAPFTGLKSSAAFPVTRKTNKDITSIASNGGRVSCMKVWPPIGKKKFETLSYQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKIHHHHHH

SEQ ID NO: 1204 - protein, 422 aa, Artificial sequence
  Optimized for Zea mays
MNNITEYNDTANFVPYNVYATSAFEFDWDSSAILKQAVLKGISFIPYVGDYLSSIIGFFWKDQERDIWQEILGRVQQLIEENVLKAIKGILLGDIAELKGKIASVVAALQDHPGTPEAKSLFMSVSVHLDSVQRKFTTFDHKTNYHILPMYSATALMQIMYWTMGIERKDDIGLNSNEVGQLQRNINLLVTHVEDYVQGIYDTELEIQYNDSAPNTVANNVMYVHGYCRVHGLEYTEIIQSIQNNGSNTKGLYSKILSYSTFFGWPTSQARILALKDEVNMPEPFKPKLINGRINQVKSVKGYIRRIGGALRVGGLEITFENGSKYSQGTVTGEFSSIDLNGSVIETMETWGSGAIDEAKFTLSDGRTFTVGQRYSTNYRKFALEGHYISGIFIASDRSELAGQAANICVSYHQKQHHHHHH

SEQ ID NO: 1205 - protein, 142 aa, Artificial sequence
  Optimized for Zea mays
MSKVTITIDSNSNEVDVKNSTEADTESLALTAAQVRTRVPTEVAPNSSTEVLYRSTPIIPESRRNVMITNDGAANVITAQYYWSHSFTSQWFLYTSIDVNVGDSKLLVSPSNSLYYSKVVLINNTSRKAYVTAEEKHHHHHH

SEQ ID NO: 1206 - protein, 799 aa, Artificial sequence; identical to SEQ ID NO: 1070
  Optimized for Solanum lycopersicum

SEQ ID NO: 1207 - protein, 799 aa, Artificial sequence; identical to SEQ ID NO: 1070
  Optimized for Solanum lycopersicum

SEQ ID NO: 1208 - protein, 799 aa, Artificial sequence; identical to SEQ ID NO: 1070
  Optimized for Glycine max

SEQ ID NO: 1209 - protein, 340 aa, Artificial sequence
  Optimized for Zea mays
MAPTVMMASSATAVAPFQGLKSTASLPVARRSSRSLGNVSNGGRIRCAAGVTNTAATDAGIVDWSTPIDHAMDIYGQHAGKPGTYGGSGLLGGFTDVKYREFSVEADGSPILSNSKTVFVGSSTLVNDSDMEQTLSTDSFTQQFTNSVTSSTTTGFKFGEKISSKFEIPLVAEVGAEVSTEFDFSDTSSNTKTETHTYTAQPQNIKVPPHSSVEVIVKLDTVKASGNVKLLSKMSGQKTGSIIYYNPSVQYFYNLSFHDIVDEASKYEKLSNVYANPDETITLVGAGNYEAEYGTQFMVQVMKPKPLNENGRVKRDLHEEDYAYEVTPVVNKAEHHHHHH

SEQ ID NO: 1210 - protein, 294 aa, Artificial sequence; identical to SEQ ID NO: 1072
  Optimized for Zea mays

SEQ ID NO: 1211 - protein, 870 aa, Artificial sequence
  Optimized for Glycine max
MASSMLSSAAVVTSPAQATMVAPFTGLKSSAAFPVTRKTNKDITSIASNGGRVSCMKVWPPIGKKKFETLSYASSEKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELEKGKLYKIKITYQPESSSANEFGLQLNWITPQGKEEIIPEGNLLLPDIKNQPENESSRKKRSISASDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINKDQLTILEQTQQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDEPGVHEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSVENNDKIMAWNAYQNSTNVFATAFEGKPEHFWIPELLGNDLYILKNKKDPTKVLDVDGSGTSNGSNIQVSDYKGTDNQKWKLEQLEANHHHHHH

SEQ ID NO: 1212 - protein, 1209 aa, unknown
  environmental sample ## Derived Active Sequence
DERASRPRFYTPKASGDRASFRTSEFYANWGLNLHHFDAAYAAGATGQNVKVGQLDNPLYVKHPELAGINFSAVGSYPLATTPAFDAGTGKPAYHGMHVAGIIAARKDGKGMHGGAFGATDFVTGNFRQTSQAVQQAGGTLSKLGKTIVDAGADFINHSYGYNFGIYAIPMALPEGQFGSHGPDIRHMQRYRDRQHIELSSANGVVNVSSAGNDRYYAAYKTAFNKYDARPRLFRGIGNGAGINSIPYMNHREKNLTDADWSRIEKGILSAVILNGTKDINSYSNICGISKYWCVGAAGGMLTEPDKAYATTLPALPYPVDFYHPDASGQKYSYEKLNGNISSDRYRILSLAVTSNAPPGSPEAEVMDPKNLQPIYRMAMGTSMAAPTLTAGLAVTKSRFPYLQNWQIRDIVLSTAQDIGAPGIDRVYGWGAMDLEAAIGGPRSLFALRRDYIEKLAQYEVEAADKYNPIVAKADYYATQAYELKIQMIENAKRAAEAEKAGNQKEAAQLLALNKQLAPQEAAFRKQAYEHELTRIQPNNEADTPQNAFEYINFVVNIPGKKSEACAEDACVADVWTNDISGPGGLEKKGAGLLALAGNNHYTGGTKISDGVLQFGIGGTTGSVTGNILNNSSLVFARSDEWSYKDSITGSGEVLVLGGGTFRLQGDNTYTGPTHVYDGRFAVDGSTISNTIIYGGGTLSGNGRVGGIHVRQDGIVSPGNSIGTLTVMKSGSAGAGAGNAVFEPGSRLAIEIDGQGNHDALKVENAANIHGGMVDVGVANLSRTQLAQQVRQSMQKPYEILTAGAGVSGAFDQARLDIDLPFIAAGLRYSPQTVGLVLGRSHLGFGSVGQTYNQRQIGDGIESLSPGQPLYDGLLTSASRQEAVSSLQQLSNVDIHASLKRTLIDNTRFMRDAALGRSGFASMPNIGASADGKLLGETNMNVWGKVLGSWQKHKGDGNAASLDRTIGGLIFGVDHLMNRNWRAGALVGLSNSSLKSDRASAKIDSYQFGAYAATERERLGLRVGASLAHHEIATRRGGYPDLTSMNKADYSANSLQVYGELGYKFTANAVMIEPFVNSAYVHLRTNAFEEDGDASKVSGKRQSANVVSSILGARISNIVESGSGTAFRLSGMIGWNYNVGDIAPIASVNYRGGNTFDVRGIPLSRNAFVTEVGIQASPKKNLSAGLYYDGRFGRKVSDHSLSLGISYAF

SEQ ID NO: 1213 - protein, 531 aa, unknown
  environmental sample ## Derived Active Sequence
DPASQQLRDQQQAQRQREQLQQLERLQRLQPITSHDDRSAFTDTSDNCWSITGVRLTGNQKLPTHQLQPTVQALSQPCMGIASINQLLKGLTQQYVEAGYPTSRPYLARPPKHEQPLDIVIIEGFVESIELTDGELPLSLQGAFPGLLGKPLHLPDIEQGLDQLNRLRAYDLGIELLPGELQGGTRVVLQPRQVTSPWHLDTRLDNRGSELVGRHRLNLGLGLDSPLGMNGDLRLSMASTVFNAPGQSRGLNLYYSLPYGPWTFTLNASRMSYRAPVPESHIVSNGKSRFLGLGAERLLWRNQRGILSASARVDRKQLITRSDSTVISLQSPTLATLEAGLNLLWIDRGLWNAYLGVSQGMDWFGADRPLPQAQTPRPDFLKYRVNLLHLRQGPGHWPWRWQSELTGQYSADVLPAVEQFQLSDDSAVRGFRQHTASGASAAVWRNTLSQPLDLAWTHSVQVRPTVGLDLGWTRFARASASQRLAGAAAGVELSLPQSRLRLDYQRALYASDKPAKGLERGYWVLDWTLTI

SEQ ID NO: 1214 - protein, 138 aa, unknown
  environmental sample ## Derived Active Sequence
MPLPVVPSQPSVNPDVVNVQYYRDYDRGPRRGYHNGYRGYREPRPGYRHHDGYWFPLAAFAAGAVIGGAIAAPNYRPAPVYRPAPVYRPAPVYRPAPVGNLNPRHYDWCAGRYRSYDAYSNTFQPNYGPRRQCLSPYF

SEQ ID NO: 1215 - protein, 989 aa, unknown
  environmental sample ## Derived Active Sequence
QNNDKIPQVVLPTPQAQLYEKYVNHPTVEYTGTPEITIPLYEITVKGLKIPISLSYHAGGIKYGQFDGDIGAGWTLSTGGYRVSRTVYGQPDEQYDMYDPNELEEMWNRPWTGDIRKKIERDTYFMGLERKLHQEAYVRTQDSQHDLFNYILPTTTGQYIISDKRNKTVVTDKQNGDKIILDEGGSLSLNSMKIIDTGGFTYLLGGQQTNPSALLVETTLIPGTSASFADKAGWPLRQIQSPYGGNIDFTYKLYELPSENRFGGSFTLTDASYFIASAATGPQYSTASGSVSLSNGRYKQYYIEKITTDKETIIFKRLGFSVPGVSPANTHALSEIEIRAKDNTLVKKIIFNHKKSPEGNTTIDGFWHMLLTSVSISNGTGEPQTYSFAYNEPTLSSPVYADQWGYYKNAYEGRPGGRIIWNKLFLHKEFADEVLMPWTNPNHSYEPTPLKYVWNGTYPGTASYNFVDRSNNSSAGLHFFSLSRITYPTKGSIEYAYQPNKYEAGGETISGSGQRVWKIISNTEDGKPSIVTEYTYGKNGDGLGSVSSSAYLSDRFFATTTILSEIISSDVTLVSSNKFSQVRTYSSSPYQADLLDLMTVVYPEVTTSQYDTSSRSYNGKIVSTYHIPFKIGCSSIGGTSIQLGNYPPPTKYWNDYYINIYNFGNQPYLKSRVTYNNSNLPLIRESFEYENLKSQIFKGIRAIQKQSCVDRPVFLYYELYESPYTYIDPMCIADRIETTLNFNRIKSKEVVSFEGSDSIKVTETYQYDALNRVTRSVTTNGIGSTRQIEYTYPSSGQLVTKNKIGEPVRTKTINNNIPTGIVEKTYPLNAINPSSLRSSTGNESTLRTDITYNQYDSKGNLLQYTRADGTIVSYLWSYNYQYPVAEIVNASYTTVTNNLSGVTAASLAGNANPDDTVLSAVKALRTLLTNAEVTVYKYRPLVGIIEHTDPQGISTWYDYDDLGRLRETCFKEFGIKRILESYDYNYRNQ

SEQ ID NO: 1216 - protein, 698 aa, unknown
  environmental sample ## Derived Active Sequence
EETSTVDTSSTEQTSQPATSEVEDSTQVSSTDQVTTPSIHVSEPAASEEPTEPSNEPEQEVTSEAPKISALAAVGDGTEANPYRVTTFQELKDALGTLVAAGQTQYIQLQNDIVYNATGISITQNTVIDGNGNALLYSGTTYDPAQFRTGANNISITYKNLSFGNSTYPNSTWYGILYTGNSGVNFTVENINYTIKNGNQPFWGNNGSGNKLTFKGKNNFYSSGSSYGGEFVEGYPTVVFAEDSETTVYNDSPNATGVFYSTGQSVTVEKRASVSIESSKDYLFYNSATLNVQEQGKFSYKTIRGTNYSSNTATLCVGTLTANFANDSIGHFTTDVNSFTGSNPIVNLNSPDYVVFDATSSSKKVIDTMNPIFKRTDSDTSLYKIAYLTASGQNTYVPKVNSGSSYTVTSSNIGNGYSVAYAKMPSIEAPAVTAATGPDISNIAAQINNAAPATTLSSKVQYKLANKQLYSGDLAADAAQSSIEQAETADDGIIEKKELALPGDGLPIGDDTKHTFVHLPPGNYHVYAKTNDQRVAGYTFESLWKESTAEVQPFIQVQFSSNAMSFNSPIPGQFGKQQNLDNYTIRNAGNVPTNINLTSITRNSDSSEKLSLVEQFDTNNQELLLSLIAEKAGSGTRTTFGPLVDKDPLSLDTLQLDPFWEADAQADLYLAGDYSGPMIGPQNFSYRFSFAISAVTTN

SEQ ID NO: 1217 - protein, 685 aa, unknown
  environmental sample ## Derived Active Sequence
QITYLDDLPTLGSNAFQFEGTQSGDSTERFLAEYGQNAANFVSEEKKQKKLADMAQDYARHKAANIATDEITQWLSKAGNTRLNINLNEKLSIKTSQLDWLVPWYDQHDFLLFSQHSIHRTDGRLQSNNGIGLRHFHQNSMVGINAFFDHDLSHYHSRLGLGLEYAQDYARVSTNSYLGLSTWRSASELAYNYYVRPANGWDIQLEGWLPAYSNLGANLKLEQYYGDDVALFGTNERQKNPMAATVGVNWSPFPLLALNVEHRIGNNGANETGAKIAFNWLLGRSLEQHLDTSVIEANRHIPNNRYDFVNRNNNIVLEYQKKTLISLSLPKVIQGVTGEERSIIRNLTTKYPIEKIVVDAPELIAAGGRLHLNGIDSSVKLPSYKITNNALKNQQLNLYRLTVTVYDTKGNVSPQVETLIEVTGTGALTITHENTKKRNNGIADGKDANTFAIVIKDPLGHPVPNAKVNFVLPANLRSIDQKNTGYYSLLNHFMWKAKAKKAVSEQKYNIIANDKGEASIQFTTFISGSYVVKANTEYGPEINEMYHFKPDISQSFISSIDIIRNNVAADGISKNKIKLRIINNSRQSIAGALVHFEASNGIISPANLTDEYGNTELEISSLVEGSIDIIATLNGDSRTIQVNFLKYAPTSYIQPSTESLFKPSINEQNRHTSLSLLRELFQKIG

SEQ ID NO: 1218 - protein, 714 aa, unknown
  environmental sample ## Derived Active Sequence
ERPSYAGAASDKPSYTTEQAAEQITRTGYRWKERNPDGTTPISYRFFTPSQATYNTPAGANEFSKHQKEQARRALQSWADVANISFTENAPDANGHLILGNDPQTGLAGYASYPGVYNNGTQAWFASGGSNYFFTHGSVSRYVLAHEIGHTLGLMHPGKYNNGGSYAENARYAEDTRAYSLMSYWWAGHLGHDHNKNGQTHYASAPLMDDITAIQKLYGANYKTRNTDTVYGFNSNTGRDFLSLDSPDDAPVFNVWDGGGNDTLDFSRFHQAQTINLKAEHFSDVGGLKGNVSIAKGVTLENAIGGTGADRLIGNHADNRLTGGLGQDILTGGPGKDTFVYNNASESTEQRPDRITDFTSGEDRIDVSAALRAAGLKDLHFVRRFSGRPGEALLGYDPRSGHHSLAIDLNGAGQADLFIKSQGPIKPGDVISQASHASTAPTRPFQVTPQPPTPAKTAPYEPRRETMALPQQAPFSLQNHANATLKGTPMHTAARAVGSIREVSVSRDSWGYERVHTRSLGTGSLINDGNSVLTNQHVRDALAKGSKLELWLGYEQDSAGRMKVERKVPLAPTPLSGDARLDYAELPVDLPAGEKKALAEQFPPLKLAPGPQASLGQKVFMPNHGQEALGISFLNAKGQPTTLKGYDQGSPYQGTVYHDAFKKPGTSGSPLISVDTGEIVALHNGSISANVNGHRASMGTATRIDLIQQHRRKR

SEQ ID NO: 1219 - protein, 646 aa, unknown
  environmental sample ## Derived Active Sequence
QRFNSVVFNKLPQDYQLYPRDGQSEGIVPISGVVEVTGYSYVSVQVFRNDTFVKYLKASLTYDNKGVGSFAMETRIKAELAQYSFKVFACKTIDSTLIVTRKNVVSGDVFIVDGQSNSTGFFDEASTDPYCRTFGKITDILNTTPYNPADTLWALSNQQKYLTGVGTMGFEIQKQLSQKYGIPNCLINGGFHWSSSVNHAQRTENNPADLNTGYGRMLYRVQKAGLQNAVKSFIYRQGESEAYHEGSDWPGNFKKIRNNLKLDFPKLEQIYVFQIDIIYFPSTTGAELREYQRRLPELYPDVQSLATVGTKQFDGLHYGPEGYRQNGLEVSRLIARDFYQLKDTVNINSPSLKMAFYTSQEQKQLILVFDEGQQLVYPEPYKVNDQLTLLMKDFIYLNGFPAGITTANADGNRIILDFANSQNASRFDYLPPYTLETNYFYPYNGPYLTNKLGMRAFTVNNFSIANGLNSSNLTSSVNPFANAVLSWTEVNGATGYTLERKLAGENDYTIAGKFSASSRSFEDKTSSFPGKISYRLKAGNSISESSAYAYAEVEIPVILGLEESGKDLFEVFPNPVVNRENVTIHFLTPVKGSILLINSLGQILKRQTVNRQPEADLFLQDLPSGTYFIQLQTEDKSLTKKLPVVR

SEQ ID NO: 1220 - protein, 438 aa, unknown
  environmental sample ## Derived Active Sequence
QHLEAAPTATFDGDWWWGAFRALTLKALAAVPEVGGILSFFGGLFIPTHLFDSEDAQWRQYIDAVNRIVDQKLDDAIYLQVQASLVGFTRTTRLFLSALQTGDAQHIRSVIDAMNVSFTASIQGFMLKGHEARLLPLFVPVANLHLGLLRQAVQQGHRRGFPAAVILDYQAQLQSGIADYGAYYDAVVEQQLQATAKAHPHDGGRHRNEPLASVYTLRSQLQISLGDMRDCWAYFDTARYPDAIQVRLDRELFSMLIGSYYDDRVPEPATVTLPVPPTGPIRSITLQGYVFVDGLTLSYAAGQGPDRVDAVHVGGAGGAFFSIDDIVERGHVRAVLVQHGYAVDRLGLEYGDGTLSGTVGNTGNQDPAARLAFPGHHLSSVIGFGTAAGYGGVLSGCMFGFQLDEPSAPVAFDRRVQDRLQRVWPSGLQAALRRSAQG

SEQ ID NO: 1221 - protein, 373 aa, Acinetobacter Sp.
  Derived Active Sequence
GAAEKWQYDVIPDKSKNIINVTAKNITQNAANDLTYKVKVVPNSSIVGRTVLRRLFSRNVAAFATVAGIELTLKSLGYSLDYDSQTVYREIKTDSDIGWIDLNGIWHNDPNKWGKAWVDTYNSNGATPKAVFNRVELDEKNTAYLWVDRTYGAETYTSNVTSSASQPNPNPQPTPNVREILNPEAIGDIVLGNPPKPVNFSPELPLPSYPPVYSPELSNIFKPVPDVNYPNDLDPAPNQVIDLLDKSQPSSSDQIITTTPTPDGSSSLLPNFCDWATPICSFIDWFKDDSAIPEPEKYEVKEFDKSKLPTAPQFSFNGQCPAPKIFNLNLGLASTQISLPYDYFCSFATDVRPFVILAAWLHACFIFAGFVRS

SEQ ID NO: 1222 - protein, 956 aa, Enterococcus Sp.
  Derived Active Sequence
GSETSESAPESQNDPSLGLERNATITFETSPSEGGRPSFAPHINPPWGSLLYTISANPNQGFRFVRWELINGLNASISNLNEETTILSISTGGPIGPPVHETITIRAIYERVYNLTFQSSPIAGGNPRADQTILAQGETTTIHANVSNGYRFVQWELVSGNTTIANRTSQSTSITMGAGDSSIRAVYEQITHSVSVQANPTIGGNPTASASSAAQGATINLNANPAVGYRFVNWQFLTQNGATITNSNLANTNLRMGTGSVIVQANFERLQQGSVIVRYVDEVGNELAQSDMLTGFSGESYRTEAKAIEGWELLAIPVNATGFFTNVEQIVTYTYRKNQQLWGTVPWEYDEATKTIHLYGGIAGSVPEAPWKSTFEVETIIVTNEVFLPENSASLFNGARQLESIEGVGNFNTSKVTNMDEMFARTSALKELDISQWDVSNVTSMSHTFAWMSNLRKLDVSQWDVSNVTTLSHAFAWTSNLIDIDVSQWNVGKVIDMGNLFMSSSSLAELDLSNWDTRDKDIRGMFHLASRLSSLKLGEESVIGNTSLRTIVPTAEYTGRWVLEESLDSSVRTIAFENSNEFMANYDGSHPGTYVWERSRPEELVAALEPLSDQSIAITGWMTEVTDNRTITYQNTAGQTVTVTKESPRIKWGDYQDADQRIRQFEIPLTENERLATDTEVTLTVAKPSVETTGDLTIEKKVIKGLDYTANHFTLERKKLEALTSEAELHELILKESQATAHDVLTQDDRSQEIKIVATDLTKDDVDDGTYFATFQVGNKAYQFTIGIDVNSKIHHLKVSIPTKMVFESLYQGEETNREFVSPDYEIRNHSDLSVDTYVNQFIIEDDAGVILLREDENPLDHAPLQEGQPKNFSDIKQPLLELQLMSNETKISLYGRRSEQRLAQVAPYSSVPFHLTGRFYGPDPKWIAESDNEQGGYYQDSFVPTYRMILRFVPR

SEQ ID NO: 1223 - protein, 971 aa, Enterococcus Sp.
  Derived Active Sequence
IENSMELPSTSELPDPLASKMETKAPIFSFEENQEPQMANKQFQLVVRSSQDVSEFVLNLPEGVSILEDKQSTDIKFKNIEGNQWQVQTDSPQMTFSIPLVGEKAGAYEIAVGESKTMLNIQPEESPQTTEQEIISSEENETEKTGESTVEEEANGDREEPSSTTDTSQNDPEQVTENARLTKEARVQDVTNWEEFIQAFSDQTISTIEISNDFEVPTTPLANQTGLLTGNNSNVSGSATFVYLIKSSISRTLTINGNGHQIDFGSVSLGMYPATHNENSPWNITFNDLDVYSGNWWGFFQTTNLTVAQHSVSNITLNNITSYGNELIAPYYTNVDISGVVNNHITETYTSKFRTNWRVNTVNSVNLETRSLTIKENAELNLSSVNSGNLIIGLGGLDANLTLEKNARINIESNGASAGDNANGRGSSIDIVNGNLIMNEGSTINVMTTRNFSALNLRSANSLVKIDDGSKININSISHTWASNAAHRNLVYMATGSSLSVGEESEFNVEATGRGTAASNIVHIAGNANFAVDKDGTLDIKSDSTSTSQSLLSFASAGSTFQFSDAKRVNLERTGTIAGTSTTNGLINIAGSTGLLDIDVQSVKQWARGNFEETPDHSWTPIFNLNLRYTGVVPRIETVSSIAQETADSFKQYFTTQNVQRILFEKIPDVEVTIDPLTEDPNEVNSHTITGKANPNSVIRFSGDPAIPAGSITSPDISESEKYHTTADENGDYRYELPEDRRFTAGNTVTAYAFLNGKNDTASTMVEEKIVVAPVDPLDPETEVEPENKPEIPEDQGRLSLDFVSQFNFETQKISVSDQTYYAQPQRLLNEDGTVNETEERPNYVQISDRRAANERNGWQLSVTQNGQFRNKSGNELIGSEIQLFNQELVTAQGGTKPELQEEPVQQILPNTRKVLIKANGESGTGTWIYRFGDQQTANKSVGLYVPGGTNPEATSYSTKLTWELSAVPEN

SEQ ID NO: 1224 - protein, 371 aa, unknown
  environmental sample ## Derived Active Sequence
NNQLKDSCLQTATAGLVVQTYCNQVAIQPAFNLPDSVKTKMPDVDAYLTAAQTNANHYLRNVQPRIIAVIADVGGYSSEFGSFYGLIDQKIQQWKTGSDDGKKDALLLLNQLEVDLQGKLSNVKGVQSDINSFQTMVNLDTSHFNEAFQSAQVIIGGNQGAIAAYNEQIGSLNKQIAGASAGVGLSGLSIIGGGILVCVGVFASSVTGGLATGLVVGGAALVVVGAGGLVASSIALVNLINAKANLIQQKVALEQNLQALTTFKSSISDLKDSAASAAQQLTNMHNAWSFLGRNLGEVVTSVRNAQTYSELPIVVQAYLNTAASQWEDVKGSVKTIERQMTGVSTSTLKDGKGNPAQLTKQSIINYVSHAA

SEQ ID NO: 1225 - protein, 440 aa, unknown
  environmental sample ## Derived Active Sequence
SQCSGEPLAQNMLCAPDEGIVPDTGADLSAQIPALLEKSSAEKKGIFFPAGEYLFSQDVVMTSWNTLQGSTQGTVFRGISPTGSAILVGDETYTNTVTDLTVSHIIFDNARVGFYGRKNRINLAYNAFVNTRTATNTGQLTASTNPYLIRGNIFMRGNGYPGVGLNTYGNAPGLIIEHNFLGSPDKMSKAAPWLLDDTKALLETMLTLREQGKLAFDDTQDKFVAGWYSTSNLRDGTFRNNFFSGSTNSKLYNPDTGAEDITRDHAVYIKQYDKVVVTQNYFGGWPEDASGQLKFRNANGLVFAANYLDNISFNARPYDNTEPAWWIMTNTFIFNNYVKNGIINYWQNFYDTADKFITVTDYLVFSNVFDVENKNDCLVSGQSISLSEEFYESNNRFSDGTDGVVTCGVMNPLSLDDITARLPDYASELLNLQPLKPGAD

SEQ ID NO: 1226 - protein, 584 aa, unknown
  environmental sample ## Derived Active Sequence
NGKVYVGQVDTDPTIPSNQIQVYIENEDGSKVPVSQPLIINAAGFIVYGGQIVKIVADSNYSMAVYDAYGTQEFYFPDLLKYNPDQFIPELADPDSTVIIAGTEASKISYAATITANMNTVQELIAAHVPDNIGIVITAGYYDVFGKRDVWVRSTEMDLPSKTPIQLNKLSVTDANGSVWNLDISSGYIYIDSIGAKGDGTTDDWYHLELCFKNAEQGTNRIVKGNKSAYFFSKPILLKTGRHLEFNAKFGVDITYGGQLLSSTDAPSATTPIGSGFTSTFSDKQAQIVVAHKDGQFARYWSVKNCYIKNDSGTSSTFGIYCPFGNAFDLEHVWSIGGLTGFDARNIYTYSFSGCYFAAPVGITGTVGINVTPIQNGLGSGTSGTYERVGIVGYKYSWIFTEMNYTTLTSCYSEDTRTRYALFLTRCNGININTYGIENLTVVSGDGRLAAIADSQISINALQASYNINLSGVSAITVTGNSQVTINDVFIVAVGSPYVPLQTDNTSRVRMFGFKSTGPTPLVNITGLQTVIYGDQGRTECAKFPGNWNGGFLRIGDVRLWDDGTGLRIKRGTDPANVSDGTAL

SEQ ID NO: 1227 - protein, 119 aa, unknown
  environmental sample ## Derived Active Sequence
YSTALNPNNSLEKQCEKEGGGSYFIKNAHITFMNATVMWNPENSAGDWKVHNAINIKLKYNVENSTKEAWFGVFGENVARGSSAFGLSSFAQAMFLLKAPVDVCVKGKYLRGIENNTAS

SEQ ID NO: 1228 - protein, 407 aa, Bacillus Sp.
  Derived Active Sequence
ETKQDNIDISSALRKIGAHSKLTQTFIDGALASPNVQLEEVPSLNTTQFLIKQDMKEWSSELYPKLILLNSKSKGFVTKFNSYYPTLKGFIDNGEDKEGVTDRLEVLQDMTITNQESVQRQINELTDLKLQVDKKLKNLDTDVIKAQSVLNSEGTGKIDKLKNEMLDTKKSIQNDLQQIALLPGALNEQGLKVFQEIYSLSKDIIEPAAQTAVVAYNKGKEINNAIVDAEKKAEQEAKEKGKSAIEIEAAKKEARETIEKSKKGEIAAAAVTKTKEYDLMKVIDPEKIKKTYNTFAEINKLTAEQRAYLNDLEKQNQKLYDLTTKLTVADLQKSMILFMQNDLHTFANQVDGEIELMKHYKEDLGLINNSITKLSTEVDANNTQSQKDTLRRLKSVTTQLEEQVYKF

SEQ ID NO: 1229 - protein, 379 aa, Bacillus Sp.
  Derived Active Sequence
QEQTAQEHKIENYALGPDGLKKALAETGSHILVMDLYAKTMIKQPNVNLSNIDLGSGGGELIKNIHLNQELSRINANYWLDTAKPNIQKTARNIVNYDEQFQNYYDTLVDTVKKKDKVSLKEGIGDLIDTIHTNSNDVTEVIKMLEAFKTKLYTNTVDFKNNVGGPDGQGGLTAILAGKQALVPQLQAEIENLRSTQKSHFDNVLAWSIGGGLGAAILVIGTIAGAVVIVVTGGTATPAVVGGLTALGAAGIGLGTAAGVEASNHMNSYNEISNKIGELSMKADLANQAVISLTNTKDTLTYLYQTVDQAIMSLTSIQQQWNKMGANYKDLYDNIDQMQEHKLSLIPDDLKAAKQSWNDIHKDAEFISKDIAFKQEKTN

SEQ ID NO: 1230 - protein, 346 aa, Bacillus Sp.
  Derived Active Sequence
SESKIEQTSTEDISLSVNSEKMKKALQDAGVFAKSMNDYSYLLINNPDVNFEGIDIKGYTNLPSQIAQDQKNAREHATKWDAHIKKQLLDTLTGIVEYDTTFDNYYDTLVEAINEGDADTLKEGITDLQGEIKQNQAYTQNLIQELAKLRDSIGEDVRAFGGHKDILQSILKNQASGIDEDEKRLNDVLEQVRHFKQVESDGIITVSVPSIPTWIAGGVMIGVARDNLGTLEPLLAQLRQTIDYKITLNRVVGVAYNNIAEMQNAIGLAINALTYMSAQWHDLDSQYSGVLNHIEKASQKADQNKFKFLKPNLNAGKDSWKTLRADAFTLKEGIKTLKMDPVSSKK

SEQ ID NO: 1231 - protein, 876 aa, Xenorhabdus Sp.
  Derived Active Sequence
GGITPDNPKTQVHNNGNVPVVNIAAPNNAGISHNTYKEFNTGIQGAILNNATQAVKSQLAGQISANANLHGKAAELIINEVTGSSRSELLGQLEVAGQKANVMIANPNGITCDGCGFINTSGAIITTGKPQFDTQGALEALKVTKGQITIGGKGLNGQSTDYVDIISRATELNGKIQAKNLAFTQGANQISFKDGTAKTIAGEGNRPQLAVDTKALGGMYANKIRLVATENGVGVNLKNITSHQQDITLSANGKMELGNIKAKTDLNAGAKEINIGPNSPVQAERDIVLASSKLSNKSSVTAGQDMRIYGDTISNAGAQALLQANKNMWIQKNAEGGKNELVENKSGTIKTNSGDLIIRTQNLVNEKENVQVTKTNHQINSNAGYGDYPKFKFDFNKPILIDSRHKDIKLEHADFVSNVDSKQAVIESGHDAYLYGETLTNKNSSISAKNNLILTGTHLKNSGVSFGLLEKYKEYFRSENRENILNRDILIWKNNSVSQSILSAKNSLVADFKESISIKNELPSEANNINQVIYGNNYAALNAKNILLHAKDVYLSNEIKADKDVSIIADNAVKTSLAVLNAGENISIAARYDINLLDSNLKSKNISLISHDGNVNVKNSLRAFYPDNTRLLSKLDASADLSISTGKDIYIKDTLFVSKSKNIAFNANKDITIEHTDDLLNHHNPIQQLSTDQEAKLFDSLSPTAKLDSSGSILINSGGNLSLNRVNLDADKDIDLYAGYNFNQYSKEFEPNHFSVSTVTKALKLQTHIRSGNNLLINAQHDITLEGSDISTQGSTNLLAGNSINLLGIPYFFENNGVEVLKYALPVIAIPPNKNIITTIKANKDINLISGAYYHPSRSPNNIHQDHLIPFNEIAQ

SEQ ID NO: 1232 - protein, 471 aa, unknown
  environmental sample ## Derived Active Sequence
QGSVSSTSLQVSADSSDYYIIGSDFYNHFVRPTTVDLAKNKVVYNKQILTVYNGRIDKWKMSFLNQDSSGKSWFKFLSYPEATKGDIKITYTTDGINYSDSKPSLEQLKGYMVELLKPIVYPDDANNQENDIEVSFQLSPDTDYILSNSNLNKQFIPFSGEYWLQNYSPYPFFTDRNQLQFVYPDYSKGVMVKYVDEEGNEIHDPQTISGSKGDVYDASTDQYKLVLDGYTLDTSKLPQNSIGNFKEALQTVTYVYSKNPVVAADVTVRYVDIENNPISEDIILQGNIGENYYTDKKNIKDYTLKEVQGNSSGQFSEKAQTVTYIYKKNELPIATGKVVVKYIDTDGKSILKDVVRTGTVGEDYITEEKNISGYTFQGIRGNSKGKYTDKIQTITYVYTKNHIIKPKDELVNSGTKIINKTNPKVKNSSSEKSQKLPETGENKKRSILFFISGLTLITLGSTIIVFRHKKE

SEQ ID NO: 1233 - protein, 142 aa, unknown
  environmental sample ## Derived Active Sequence
DSTVSVKGVVTSIPCTITQKNNGIVDFGDVLTTRIDGSSYKSYQLVLDLQCDTPVNADTMLNLSLSGTEAPFGEGLLATDKEGLGIQFRWGDQKYPVNSAVSFSYLNHDHSVYMSVTPAKDDSVELEGGAFTATATLTVDYQ

SEQ ID NO: 1234 - protein, 1681 aa, unknown
  environmental sample ## Derived Active Sequence
ISSIESKTEKTSLVEKKQFSIEPNKEEDKINNKKIAIKDESNEQPIEKNKRTSARNNNPSDNFDSVQGNNGNYFKPTTDATLLKIGEEQAARVQSDLSKKSINISNLQHEKDDSFEVLNFSTCIFPNDKGLVMWPINGGRNSVYWTQVDSNSGIWRMRLYAAMDSKNEPYLNAKFTRLKYGSVSGNEVFAFPRVAYLSNPTGHINDMKPFLTKATFEVRLPTAEEEIGKIVATAKEGTHKLMQNAQPIPNPETYLDVKNTRGKVEYSWKIAPDTTKVGKQDTKILVKDESGREIEVVVPITVEPLAVEIKGKPGPFDIYQYDKLPDVTEYFEVTNLYGTYTLKWFDDVNTDSPGEQTWRAKVTTSDGREATSSIQMDVTPHEGLKVNLKSIEDRKLGYNYPTFATNFRDYIDSVTMHGEPVELRDLEFIPQESAEADYRIGGLQTLKLTVQTKHPNSGVMIKGTGEVTLNVLWDHSILMKSINGESAGSFTLRTDNSGNETAKVVFGMGIPTSINTAVGPQSTPFSLYYSFEVLRGETVIYSQEVTNRATWQQIMDKFGDSTGTIDVHYGDVIKIYHPERTPNSSVLMIDEQEQDYTYDTTYAYYKITPYGFDPFPLLEAEASQKSFVLGENTKTIDPASLIKNVTINGRLVDSSSYEVESLIDFDTSSIGTRKMKLKVTMNDGLSAEEFEVDYQVKWGSTFVLKGLNDATVGAFSLLKENDQWALHASQGVNGTDLSQPVNNHFGRDIYYGIEVIENITTKYQYNVLGNQSIKEGIEGFNQGKPLTVKQGDVIKVYHAEPTGNSLLMQDEIAKDFTMGSNDAYYEVTEHGLEPILAISTDTKPQEFSLGDDASGIDGTQLINQVTINGTELTPDLYTVKQLGNFDTTTVGQKELAIQFDTKDGVVSKVITVPYKVKWGRTIVMKSSTGGSAGVFSLQTTNTTRQLKIHQGFDSPLDERLGNDQDLYYSIEVLRGEKVQYSQEVPGRVTLQEVINSFGTNGTPAVTVQLDDVIKIYHPQKSPGSSVLMVDELEEDFTYGSDYAYYKVTTYGFEAMPVMEVHTANKAFYLAQDVTTVADAELIDRVTINGKTVDPEEYTIERRSEIDTKTIGNKNVAMRVKMNDGLSSVQLELPYQVKWGSTFILKGEEKEGKRGIVGSFSLLDQNDQLAIYATKGEDETELNAPVNPAYGRNAYYRIDILADPKNKANSLFPDNIKYTYEVAGNQTVRQAIEGFNNGQSLPVEEGDIFRVYHAETDNQNLLMWDDIVKNYTAGLNYAYYEVNNGEFEPITLIYADVASQELVLGEDTSEVDVTTLIDNVAFNGQSLNSELYKVEQTGAFDTHTTGEKTVTVKVSTADGVSSTDIEVPYEVKWGSTIHLKNRKGETVGSFGLLKNSKQIEIQSVQGTDQTVLKNRVNEYDDTEVYYGIEILNERKQSKYQYEVRGTQTIEQAISRFNTGKSLAVTPGDIVKVYHVDTSNNLLMAEESERNYTYGSNYAYYKVTDYGFEPTGELTVEPAQPSFAQGTERVDLKSLVKEVKVNGRVIPKNVYTVSLDGTSEIDTETMGSRFVSLDVKVDRSYGSLSTRTESSYEIVEPGQETAPGEEDASAEDGTGTSNDPDADGISAETGLGEGSAAEGDESKLPQTNQTINRVLPYIGACFLLIVGFVFWKRKMSKKSFDKQ

SEQ ID NO: 1235 - protein, 501 aa, unknown
  environmental sample ## Derived Active Sequence
AIDYNLFNYNYPVSAYYPKSSDKANVMGRIIKINNVRNDYSVSIPIDVSQNSEGKLNYFGLTTSTNAYFTHDSGNSITNAGSLTGPNTLVGPGLQNPVKLPIPSSTITIDGQTYYFNYYVVQVVTEKVISPINEVQGNNYALQPLDTLPANANFAWAYYSDSPGAIIHYKTEDGTELLTSPTLISESGDTIPSEVRDFTGYTLVSVPEEDSFKKAQLTNLTYVYRKNPVAAATVTVKYIDTQGNYISDSIPLSGNVDQEYTTEQKIISGYTFKEVQGNKSGLFSTTPQTVTYIYAKNPIEIKAGSVTIKYVDTNGNSISDVITKSGNVGSSFDSEQKVILGYTFKEVQGNKSGLFSTTPQTVTYIYTKNPIEIKTGTVTIKYVDTNGNSISDEITKSGNVGSLYTSEQKKILGYNFKEIQGIAEGQFTIESQTVTYVYTKISPPTIIKTSVIPPKTLSVKTLPKESLPETGNKFFGFTLLSGSLLILVSTTLYLLKSRKYK

SEQ ID NO: 1236 - protein, 533 aa, unknown
  environmental sample ## Derived Active Sequence
GQDSQHRMANDQNSVIYVCFSKGINSEKAAFSRNADLERFSRENHISFKYDLDFTDNKLDEMARNSKAIGNSTESVEKLKRIYKADLPLQSTETAEKIIRTLERFPEIEYVSVMSAEPVEPPLVNAFVATPDLESLQTYLNDNPGINAKYAWSRGITGQNIRVRDVEYGFYKTHEMLSNQNSIQLEPGYSPNSGLANNNYRDHGTAVVSILGSIKDNIGLTGAAYSTSEIKGYMEWTTVGYNRASAVSRSINASQAGDIILYEMQTGGKDGQYCPAEYDQVIWDLTKAATDSGIIIIAAAGNGNQNLDDPFYANYLARGNSGAIIVGAGSPNTTHSKLSFSTYGNRVDVQGWGSSVLAAGYGSYAKYDNDNNRTYNYFSGTSSATPVVSSAAILIQSFYRQTTGQYLTPAAMKNLLISTGIPQGGTVTGQKIGPLPNVKNAILQLESKFATPVKTLSALEVKIYPNPSSSSIAIQSNENKKLDIEIINLQGRTVIKSSVLSHEKIDISQLPAGQYIININEGQRRVVEKLTKI

SEQ ID NO: 1237 - protein, 531 aa, Chryseobacterium Sp.
  Derived Active Sequence
QKPSNGDSYAKANIYVCFSKGIASAKAAFAQNPELEKLARENSMSFTYDLGFTDEKLSEMARNSKLNGYSPESVEKLKRIFKADLPLQNEEYAQRLAQALERFPEVEYASVMSSTPVEPPLINAFVATPDLENLQTYLNDNPGINAKYAWSRGITGQNIRIRDVEYGFYKTHEMLANQNSIQLEPGYSPNSGLSNNNYRDHGTAVVSILGSVKDNIGLTGAVYNASEIKGYMEWTTVGYNRAAAVSRSINASQAGDIILYEMQTGGKDGQYCPAEYDKVIWDLTKAATDSGIIIIAAAGNGNQNLDDPFYASYMSRGNSGAIIVGAGSPNTTHSKLSFSTYGNRVDVQGWGSSVLAAGYGSYAKYDNDNNRTYNYFSGTSSATPTVASAAVLIQSYYRQTTGQYLSPAAMKNLLISTGIPQGGTVANQKIGPLPNVKNAILQLEGKSATAVKALPSLEVKIYPNPSQNVITLQNVENKKLDFEIINMQGRSVIRGTAMPEEKIDLSSLLPGQYIITISEGQRRVVEKLIKQ

SEQ ID NO: 1238 - protein, 532 aa, Chryseobacterium sp.
  Derived Active Sequence
GQESQPKLNQDQNSIIYVCFSKGINSEKTAFSRNADLERFSRENKISFKYDLDFTDGKLDEMARNSKAIGNSSESVEKLKRIYKADLPLQNEETTQKIIHSLERFPEIEYVSVMNATPIEPPLINAFVATPDLESIQTYLNDNPGINAKYAWSRGITGQNIRVRDVEYGFYKTHEMLTNQNSIQLEPGYSPNAGLANNNYRDHGTAVVSILGSIKDNIGLTGAAYNTSEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTYGNRVDVQGWGSSVLAAGYGSYAKYDNDNNRTYNYFSGTSSATPVVSSAAILIQSFYRQTTGQNLTPSAMKNLLISTGIPQGGTVTGQKIGPLPNVKNAILQLESKFATPVKTSPLEVKIYPNPSSSSIAIQSTENKKLDFEIINLQGRTVIKSSVLSDEKIDISQLSTGQYIININEGQRRVVEKFTKL

SEQ ID NO: 1239 - protein, 533 aa, Chryseobacterium sp.
  Derived Active Sequence
GQDSQPKMANDQNSIIYVCFSKGINSEKTAFSRNADLERFSRENHISFKYDLDFTDNKLDEMARSSKAIGNSGESVEKLKRIYKADIPLQNKEASEKIIHILERFPEIEYVSVMSAEPIEPPLVNAFVVTPDLESLQTYLNDNPGINAKYAWSRGITGQNIRVRDVEYGFYKTHEMLSNQNSIQLEPGYSPNAGLANNNYRDHGTAVVSILGSIKDNTGLTGAAYSASEIKGYMEWTTVGYNRASAVSRSINASQAGDIILYEMQTGGKDGQYCPAEYDKVIWDLTKAATDSGIIIIAAAGNGNQNLDDPFYATYLARGNSGAIIVGAGSPNTTHSKLSFSTFGNRVDVQGWGSSVMAAGYGSYAKYDNDNNRTYNYFSGTSSATPVVSSAAILIQSFYRQTTGQYLTPSAMKNLLISTGIPQGGTVTGQKIGPLPNVKNAILQLESKFATPVKTLSALEVKIYPNPSSSSIAIQSSENKKLDVEIINLQGRTVIKSSVLPNEKIDISHLPTGQYMININEGQRRVVEKLTKL

SEQ ID NO: 1240 - protein, 689 aa, Providencia sp.
  Derived Active Sequence
QILSTDNLPTLGLGSDAFQFDPLPSSDGTERFLAKYGQNAANLTSEENKTKNLSEMAQDYARQKAADVATDEISHWLSKAGNARLNINLDKQLSIKNTQLDWLIPWYDQPDLLLFSQHSIHRTDGRLQTNHGIGLRHFNQNSMMGLNTFFDHDLSYHHSRLGFGLEYAQDYAKISANSYLRLSSWRSTSELKDDYDARPANGWDIQVEGWLPTYSNLGANLKLEQYYGDDVALFGKNKRQKNPMATTVGVHWTPFPLLGINAEHKIGNGNTNETRVNLGLTWLLGKNLAQHLDVSAVDATHRISSNRHDFVNRNNNIILEYQNKNLILLSLPQVIQGVTGEEVSIIRNLISEYPLEKIIVEAPELVAAGGSITLNGLKSSVKLPSYKIEENDVKNQQLNRYRLTVTAYDIKGNMSPQAETLVEVSNTGLLAIIHKNGTKKSNVIANGRDPNVFTVVIKDALGHTVPNAKVNFTLPVGLTSFNQKNTSYYSLFNHFMWKAQVAKSASEQEFAIIANSKGEASIQFTASVSGSYALKASTQYGAEINEQFNFKPDIDQSFIGSIEIMQNNALADGNSKNKIKFHIVNNSRQSIAGAQVYFSGKNVAISPTIPTDEQGNTELEISSLTAGTTEIIATLNGDSRVIPVNFIDKNATYHSQENRIVYKGALFRQPTHKPATQTDSLWHLFGQLF

SEQ ID NO: 1241 - protein, 436 aa, Comamonas Sp.
  Derived Active Sequence
NDDLPMQDEVRQSGLAGDIYDVLRESILIGAFAVPVIGGFLSFLGASFIPSSGESPEQMWNRLMRARISDALLRLAQRDLVGLSEVSRLYKIAIESGNSDEIRAQSIAANTQFTAMVPGFQVRGEEAALLPLFAIAATLHLALLRDMVLKGRDIGLSDGLVARYTSEMVVLIRRYTIYVDTHASSTIDKARRDNPHSTVGLAQNMPLSAMLIEKTKYQLTVLDLRDTWANLDPIRYPGKSRIKLDREIFTPVIGWLGRKNSRPDVIPVWRRPSSPLSSLEVWDRMQWRTRFIFGFDAMYEDGSVMSSGSRISNSHNVRLGKYINRVTAEAAAGVYQMRFRSNDGRWTKVGRDADDDTPIRRFDSSYSGHRLSSIRHVGIGMGAAEGAVRGCVLGFQLIHPSGAPMSREALNSMAPKIAPQVLKWLEDEAIPNHGLI

SEQ ID NO: 1242 - protein, 425 aa, unknown
  environmental sample ## Derived Active Sequence
HGFVGDDSGNPTHTLTARAALKANGDMGGAQWEPQSLEAPKGFPASGPADGHLASAGHEQWSALDEQREDRWQKNVVEQGDVTVDWTFTAPHMTSQWRYFMTKEGWDPNDALDRDDLELIETVSHDGSAASNNPSHEITIPSDREGYHVIYAVWDVADTANAFYNVIDVDVQPADGETPEPGEDTEAPGLVPDAAVRAVSSTEAEITWGAGSDDRGVARYQVVQLGSTQDEFRVLEEHAATARSTRLTGLQPGALYSFGVRAVDAAGNIGVAHSILTVRMPEQAAAPAAPKHLHDMGTTESTVALMWTAGDDTAGVRYEVFRDGERVGETGATNFVDVGLRAGSRHEYTVRAVNLDGIASAASNTHVATTKGDAGSEYPSWDAHGAYTKGDRVTHQGSTYEAVQSHQGHGDPNWITALSLWRPLG

SEQ ID NO: 1243 - protein, 980 aa, Paenibacillus Sp.
  Derived Active Sequence
YTYANSVHKSVYSNNPVEQSSIGILSTSVYPDNAVVKYGEKIYINYSFNDKAHPVLINIYKDGDLQSDYYYEQSSWGDHFSYEPKDEGSYRFVVQPTDQPYYTNECTVTVYKDRIIFLPGIMGSELFLGDEQVWEPENSKNLPRIRSQINSLQMTTLGESKNNISVHNSISDYDDILAFFKNEGFHVVDFPYDWRLGSSINAQKLKERINIERAASPYSNYYIVAHSMGGIVATEFIRQGNSNLIKKMITIGTPFLGAPQAINMLETGNLTDNLLAVLLAGDAVKNLEKNVPSIYELLPTKDYFSYQTNGYIETQTYQDPYGPRMKVRKYNTFSDTESYIKNSRDWSNNGLFDKAKDFHSALDVLNTLKKVDSYFIVGDQKTTPGKLVYHSLSINDKVLADVKSIQGDGVVPVSSATVGFKLDKARTFYITRSHLGLVKSTEVQQKILKILKDKPNEFVSDKIRNETKEIKTIKFKAECPVELHINDSSGNHTGPTGAETFESNIPDINYFTDGETKIALVNDVENYKVRIVGTGYGELTFSIVWSNEKDIEDRTMRFDNVAVTPGSIFKADVNQNGQVVLQIDQNGDGNFEGSVSPTVELDLGGTQDETIPTISSHVDGVKGINEWYGKNAFYNLTGADNASGVYKTFYDLNDSEFKEYNEPIALPNTGIYNFKSYVRDKNRNDSEVLTEIVKVDTTSPTVPVMTVDPTTWTNKFVTITLDGGTDADSGFQKYQYKINQDGEWKDYKDPFVIDTEGLYNVYARSVDNVFNLSGEVTGVTKVDKTNPQKPLMKVEPLKWTNQSVEITLSGGSDTDKGFPNSGFQKYQYKIGLDGEWKDYTVPFIIDNEGLNNVYARAVDIAANLSDEVFGDAKVDKTRPSKPTGFDIDLFNYDNVRISWSPSSDNVGVTGYDIYQDSILLDNITDTAYTFNNLESNKSYTFKVIAWDEAGNSSLEGVNVVRTPLSLVGTGRDHSLHSMGS

SEQ ID NO: 1244 - protein, 792 aa, Brevibacillus Sp.
  Derived Active Sequence
ASSEKEIINDQEANFKGLLGYYFNDKELKETALISNSESGDLFVDNDQIDDMLPDELKQFQSAMWRGFIKVEKSGEYTFSTSDNDHTMLWIDDHQVIDHSSATQKIELEKGKLYKIKITYQPESSSANEFGLQLNWITPQGKEEIIPEGNLLLPDIKNQPENESSRKKRSISASDDGVEDSDGDGIPDSLEIEGYTLDVKNKKLILMPWIEKVHGKKRTKSGAPLTKYTSSPMKWSTASDPYSDFAKVSGMIDKKVKVKHPLIAAYPNLQVHMDKFIISKNRNETLENGGNTSSSISGSTSTSNTHSTEASVGAEVHASLFNFGGSVSTNFSDSNSQTVTIDRSSSESLGRNWSKSLGLNAGEAAYFNANIRYVNNGTAPIYEAAPTTSLVLGKNDTIATIKAKENHLANVVLPDRFYPDKDQAAISLQTKDDFGSSPITINKDQLTILEQTQQMRLETDQVSGYVGVIDPKTKLIVVDKDKQWSHIIPQIEETTARLILKTPDNSELERRVAAVDPDDYTEQTKPDVTLGEALQLAFGFEDKQGKLSYNNTSIDDFRLVFDEETAENIEKQLEDMETKNIYNVQLHARMNILISPKKDEPGVHEGLSSWEIDGEDNYYKYDVLQTGWQTINGKKYYFNENGTLVPNKVIEDGTYQINTALKNTSLVDWNRSDNNITVWETNDGSNQKWKLKYDDSQQAYVIRSVENNDKIMAWNAYQNSTNVFATAFEGKPEHFWIPELLGNDLYILKNKKDPTKVLDVDGSGTSNGSNIQVSDYKGTDNQKWKLEQLEAN

SEQ ID NO: 1245 - protein, 618 aa, Bacillus Sp.
  Derived Active Sequence
AIRSHAPSVYVTPQNTAASDIISIDWSPVLTAPHTYWAVHNWNQGGEGGGYAGFQQQSGFDQTGKRTLHFALWDPIASNQAIKAEYLSPISEASRFGGEGTGLKVQTTYNWKDSEWYRMTIRSWQEDGHTKFGQWIKDNKLNQWKLVAIMDHPVANVAFNHGLSMFQEDWAGNGQDVREARLKNGYSRKVSDQQWNSWNNQCISGQHDTSYQYDGGATSEYIWVKAGGNTQSTIGTGKNFNINQPSQPEMGILDFDIQNIRFEDKKLNVSWKLKEQSTPQFKGKIEIYDNEKLMGQPLKVIDNIKSYQTEVSQTMQLPQTAFAKITLTDIFDRTVEKKVGITNGNSDILVGNQFACSLKGYSDREIAKVDYNKAAEELKIKLEAGVPHAYFNSTYASIKVQNSSGSVLYNKEIVGNRQQNTESQTVSVKVGNYIELTHIEGDAVKEKTRATLTNLENNKNETIGKTARYLVTKEGLKKVEKMPETTILDGKQFAWSLKGYSDREITKVDYNKTAEELKIKLEAGVPHAYFNSTYASIKVQSSSGSVMYNKEIMGNRQQYAETKTVPIKVGDYIEFTHIEGEAAKEKTRATLTNLENGKQEYISKKRTYQVTSTGLIRQ

SEQ ID NO: 1246 - protein, 287 aa, Paenibacillus Sp.
  Derived Active Sequence
AAGVTNTAATDAGIVDWSTPIDHAMDIYGQHAGKPGTYGGSGLLGGFTDVKYREFSVEADGSPILSNSKTVFVGSSTLVNDSDMEQTLSTDSFTQQFTNSVTSSTTTGFKFGEKISSKFEIPLVAEVGAEVSTEFDFSDTSSNTKTETHTYTAQPQNIKVPPHSSVEVIVKLDTVKASGNVKLLSKMSGQKTGSIIYYNPSVQYFYNLSFHDIVDEASKYEKLSNVYANPDETITLVGAGNYEAEYGTQFMVQVMKPKPLNENGRVKRDLHEEDYAYEVTPVVNKAE

SEQ ID NO: 1247 - DNA, 2000 bp, Triticum Sp.
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 1248 - DNA, 1919 bp, Triticum Sp.
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 1249 - DNA, 326 bp, Triticum Sp.
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 1250 - DNA, 2000 bp, Triticum Sp.
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 1251 - DNA, 425 bp, Triticum Sp.
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 1252 - DNA, 595 bp, Triticum Sp.
  Wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 1253 - DNA, 1238 bp, Triticum Sp.
  misc_feature (1231)..(1231): n is a, c, g, or t
  Wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 1254 - DNA, 2162 bp, Triticum Sp.
  Wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 1255 - DNA, 2147 bp, Triticum Sp.
  Wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 1256 - DNA, 1992 bp, Zea mays
  Maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 1257 - DNA, 1358 bp, Zea mays
  Maize Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 1258 - DNA, 1266 bp, Oryza sativa
  Rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 1259 - DNA, 2199 bp, Oryza sativa
  Rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 1260 - DNA, 1024 bp, Oryza sativa
  Rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 1261 - DNA, 2103 bp, Arabidopsis thaliana
  Arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 1262 - DNA, 901 bp, Oryza sativa
  Rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 1263 - DNA, 844 bp, Oryza sativa
  Rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 1264 - DNA, 602 bp, Hordeum vulgare
  Barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 1265 - DNA, 1729 bp, Hordeum Sp.
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 1266 - DNA, 879 bp, Oryza sativa
  Rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 1267 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 1268 - DNA, 781 bp, Brachypodium Sp.
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 1269 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 1270 - DNA, 2322 bp, Arabidopsis thaliana
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 1271 - DNA, 2318 bp, Arabidopsis thaliana
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 1272 - DNA, 1321 bp, Brachypodium Sp.
  Brachypodium RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 1273 - DNA, 1599 bp, Arabidopsis thaliana
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 1274 - DNA, 1774 bp, Arabidopsis thaliana
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 1275 - DNA, 1127 bp, Brassica napus
  Brassica napus (Canola) NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 1276 - DNA, 916 bp, Arabidopsis thaliana
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 1277 - DNA, 3965 bp, Arabidopsis thaliana
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 1278 - DNA, 4074 bp, Arabidopsis thaliana
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 1279 - DNA, 1700 bp, Arabidopsis thaliana
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 1280 - DNA, 1096 bp, Arabidopsis thaliana
  Arabidopsis RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 1281 - DNA, 2432 bp, Arabidopsis thaliana
  Arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 1282 - DNA, 277 bp, Agrobacterium tumefaciens
  Agrobacterium tumefaciens NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 1283 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 1284 - protein, 72 aa, Arabidopsis thaliana
  Arabidopsis RUBISCO small subunit (protein)
MASSMLSSAAVVTSPAQATMVAPFTGLKSSAAFPVTRKTNKDITSIASNGGRVSCMKVWPPIGKKKFETLSY

SEQ ID NO: 1285 - DNA, 216 bp, Arabidopsis thaliana
  Arabidopsis RUBISCO small subunit (nucleotide)
atggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttac

SEQ ID NO: 1286 - DNA, 554 bp, Glycine Sp.
  Soybean TVSP Terminator
ctcaacaatctagctagagtttgctcctatctatatgtaataaggtatgctgatatgcactattcaaataggagcattagctatgtttgttaatgtcactttatgttatgtgggtaagtcacctaagacactccacgtacctacttgttgtctcttacgcggctttaataaatcttctgcccttgttccatatttactaattatccctttcttcactaaaagaaaattgttatcattaagtattagtctttagaacatatgaggtctttaattgggtaggttttacaaattaactaatataaaatgtcataaaatccacgtggttaaacaaatgcagaaaatcgacgtcgtctattggaccgacagttgctattaatataatgggccaccatagtagactgacaaataaattacctgacaacatcgtttcacaaaaaaacaaacacaaaaagggagtgcattttccagggcatttttgtaataaaaaacagttaaaagggagtgcaatagaaatataggggtgtggaaatagtgatttgagcacgtcttgaagc

SEQ ID NO: 1287 - DNA, 1296 bp, Glycine Sp.
  Soybean Ubiquitin9 promoter
tccattattcgggatttagcaaattgtttgtttcttcaatatttgattgaatactaatttaaaactaaaataagagagcgtgacaaatcaaaaatatagtgtgttatataatgtttccgtgcaggagatcatataggaccactagttgttaatcttagtcacaaaacaatacatgtcttgcaaagaaaaaatcgtagacataatctgttacatttttgttagaaaagttttgttcagcaaaatgttttcatttaactcgatttgatatgctgtggttttggtatttttacacacagtagttttttttttaattattgttaagcgaatttaaaatagttattattattattaagaggcttttaaatactgaaggtgtaaaaaaaatgcttcaattactttaaaactttagacatcttaattttaaccaaaatatggagctaaaaatgaatcacgaagaaagtatgaaagaattcctccatttttttagcattttattttgtctttaaaaataagaaataaagtaatattttaaaaattattagccagagtaaaaaaaatttattaaggctctttatatttacatttttttaaatcattaataatattcctaaagtctcttatctatgcaagatttagagtgtaatattttttaatttatgtgattaaacaagtgaagttaatgaattattgaactcttaaatactcctaatttataggtattgagtgttcaaggtgttgaataatccattaatttcaaccaaccaaaatattttgatctaaattttattattatttgagtagaattcaaccacattcaaagttgttttcttatgttagagtaacaactttttttttttttttctaaatactcataaatctaatgactcaattcattcacatgacactttattttaattatgatgttcaatttcttagaaaattcgaagtttaactttttggagaccaaatttaaatcaacatgttattaattgtatttgacagaaaaaagcttaaaccaaacccattccaaactaaaacattttaattggttttggtaatgaatgagtttagttaaagtcaacctaaatttgcaatgtacgcgtttgcgtcgacgtcattagaggccagaattgactcctagaatattctagacctaccctaacaactatccgttacttttcttaatccctaatatttcaagagttctagattcttctattcgccctatataaacaacctcattctcgattgcttcctacaccactaaaatatctctctattattctcgttttcaat

SEQ ID NO: 1288 - DNA, 62 bp, Zea mays
  5' UTR from the Maize RuBisCo small subunit 2A gene
acaggacgacccaagcaagcaagcaagcagcgagtacatacatactaggcagccaggcagcc

SEQ ID NO: 1289 - DNA, 141 bp, Zea mays
  Chloroplast transit peptide from Maize RuBisCo small subunit 2A protein (nucleotide)
atggcccccaccgtgatgatggcctccagcgctaccgccgtggctcccttccagggcctcaagtccacggcctccctgccggtggctaggaggtccagccggtccctgggcaacgtctccaacggcggccgcatcaggtgc

SEQ ID NO: 1290 - protein, 47 aa, Zea mays
  Chloroplast transit peptide from Maize RuBisCo small subunit 2A protein (protein)
MAPTVMMASSATAVAPFQGLKSTASLPVARRSSRSLGNVSNGGRIRC

SEQ ID NO: 1291 - DNA, 171 bp, Artificial sequence
  Tomato RuBisCO SP optimized for Arabidopsis and tomato (nucleotide)
atggcaagttcagttatcagttcagcagcagtggctactaggtcaaacgttacccaggcatctatggtggctcctttcacaggtctcaagtcttcagctacttttcctgttactaaaaagcagaaccttgatataacctctattgcatctaacggtggtagggtgtcttgc

SEQ ID NO: 1292 - protein, 57 aa, Solanum lycopersicum
  Tomato RuBisCO SP (protein)
MASSVISSAAVATRSNVTQASMVAPFTGLKSSATFPVTKKQNLDITSIASNGGRVSC

SEQ ID NO: 1293 - DNA, 48 bp, Solanum lycopersicum
  5' UTR from Tomato Leucine aminopeptidase 2
tttaggtctctctatctacatataaatacacaaaaaattccattatca

SEQ ID NO: 1294 - DNA, 66 bp, Erwinia carotovora
  PelB signal peptide (nucleotide)
atgaaatacctgctgccgaccgctgctgctggtctgctgctcctcgctgcccagccggcgatggcc

SEQ ID NO: 1295 - protein, 22 aa, Erwinia carotovora
  PelB signal peptide (protein)
MKYLLPTAAAGLLLLAAQPAMA

SEQ ID NO: 1296 - DNA, 1340 bp, Zea mays
  ELF1a promoter
gttttagctttgctattttacgagtgtcaagatgcttaactatttcatacttgctttgtaggaatgttcgatgccgacaacatcttgctctaccagaaggtaccagctccaaatcaagaaccaaaatttaggaaaaatacgaactgcaaccttatccgtcatctttagtaattcatgtgtttatcttatttgcaccaagaactatgctggaggctataaaactatgaatgttatttgtgacatgtaaataatactagcttgtacatgcatctaaatgcatataagaaacacaatgcaccttttgtttgcattccatgtaaattataaattaaatccaaacattgaaaaattacaaaacacacacacacaacactatgcgcgcatgggcgcgcgcaagacactagtacataataataacgatattgttcgcttcggattaaattaaaccaagcgagtatgcgtgcatgtgtacgtcggatgctttgtttgttcatttgtggcccgtgaagtaatatttgggcccaatagcccattcatccatgtcctaaccctagggcgcgttccttataaaacctatctccattctgttctcactctcagacaccagacgcagtcggctgccgcagactggtagtagccggcgcgccgtcaccgtatcctcagatcagaggcgagcagaaaccacaccactctactgacgcccgacgaggtacacttccgcgcgcgcgcttctcttccttcttttttcgctcgacgaggtactctgcttcacgcgcgggcgcgcttctcttccttctcttttcgctctgccttgagcctgttcgtttgatgcccagatctactaggtttgtcgatcgtcgttatgtgtgatgagctgagccgattcatgcactgtatttttaattaagtgtttttttcctccgccgctacctttattgtctatgtatgaacttgcagcttacaactggttattgagccataaattgtaactgagtttccgagatctataatattacgtggctgaggcgcttcatctctgttttgtttgtatgacagtaggagtactaatccaagtttagcttccgcttcttcatctacctttagtatgtatttcgtatataaatacgattgcagtttgcaactgattctcggccatagatgattaccgttgcgttgttcatcgggtctagtttcggatctctgatgttgtgtgggtggggtacttcgacttgggttttcctgccctttgtttgattactggtttattgacatatatttatctattgactttttatctgctatgtttgatgtaagcagcagtgtaacattttccttcagcc

SEQ ID NO: 1297 - DNA, 18 bp, Artificial Sequence
  Primer
gaccatgattacgccaag

SEQ ID NO: 1298 - DNA, 19 bp, Artificial Sequence
  Primer
agaaaggaagggaagaaag

The invention claimed is:

1. A genetically modified bacterial strain expressing at least one polypeptide comprising an amino acid sequence selected from the group consisting of SEQ ID NOs: 470, 702, 703, 1028, and 1190-1193,
    wherein the at least one polypeptide kills or inhibits the development of an insect pest.

2. A lysate of at least one bacterial cell of the bacterial strain of claim 1.

3. A nucleic acid construct comprising an isolated polynucleotide encoding a polypeptide comprising an amino acid sequence selected from the group consisting of SEQ ID NOs: 470, 702, 703, 1028, and 1190-1193,
    wherein the polypeptide kills or inhibits the development of an insect pest, and wherein the isolated polynucleotide is operably linked to a heterologous promoter capable of directing transcription of said polynucleotide in a host cell.

4. A composition comprising the nucleic acid construct of claim 3.

5. An isolated cell transformed with the nucleic acid construct of claim 3, a lysate thereof, a composition comprising the isolated cell, or a composition comprising the lysate.

6. The isolated cell of claim 5, wherein said cell is selected from the group consisting of a bacterial cell, a plant cell, a yeast cell, and an insect cell.

7. A plant transformed with the nucleic acid construct of claim 3.

8. A method of increasing a resistance of a plant to an insect pest, the method comprising transforming the plant with a nucleic acid construct comprising a polynucleotide encoding at least one polypeptide comprising an amino acid sequence selected from the group consisting of SEQ ID NOs: 470, 702, 703, 1028, and 1190-1193,
    wherein the at least one polypeptide and/or a combination of said polypeptides kill or inhibit the development of an insect pest.

9. A method of increasing a resistance of a plant to an insect pest, the method comprising contacting the plant or a part thereof with at least one bacterial strain of claim 1 or a composition comprising same, thereby increasing the resistance of the plant to the insect pest.

* * * * *